(12) United States Patent
Zimmer et al.

(10) Patent No.: US 8,779,090 B2
(45) Date of Patent: Jul. 15, 2014

(54) METHODS AND COMPOSITIONS FOR THE TREATMENT OF HEART FAILURE AND OTHER DISORDERS

(75) Inventors: Daniel Zimmer, Somerville, MA (US); Angelika Fretzen, Somerville, MA (US); Mark Currie, Sterling, MA (US); G. Todd Milne, Brookline, MA (US)

(73) Assignee: Ironwood Pharmaceuticals, Inc., Cambridge, MA (US)

( * ) Notice: Subject to any disclaimer, the term of this patent is extended or adjusted under 35 U.S.C. 154(b) by 1147 days.

(21) Appl. No.: 12/528,737

(22) PCT Filed: Feb. 26, 2008

(86) PCT No.: PCT/US2008/054972
§ 371 (c)(1),
(2), (4) Date: Sep. 28, 2010

(87) PCT Pub. No.: WO2008/106429
PCT Pub. Date: Sep. 4, 2008

(65) Prior Publication Data
US 2011/0021419 A1    Jan. 27, 2011
US 2012/0040892 A9    Feb. 16, 2012

Related U.S. Application Data

(60) Provisional application No. 60/891,626, filed on Feb. 26, 2007.

(51) Int. Cl.
*A61K 38/04* (2006.01)
*C07K 5/00* (2006.01)

(52) U.S. Cl.
USPC .................... 530/327; 514/16.4; 514/21.5

(58) Field of Classification Search
None
See application file for complete search history.

(56) References Cited

U.S. PATENT DOCUMENTS

| 5,518,888 | A  | * | 5/1996  | Waldman ............... 435/7.23 |
| 7,304,036 | B2 |   | 12/2007 | Currie et al. |
| 7,371,727 | B2 |   | 5/2008  | Currie et al. |
| 7,745,409 | B2 |   | 6/2010  | Currie et al. |
| 7,772,188 | B2 |   | 8/2010  | Currie et al. |
| 2004/0266989 | A1 | | 12/2004 | Currie et al. |
| 2006/0281682 | A1 | | 12/2006 | Currie et al. |
| 2009/0191611 | A1 | | 7/2009  | Currie et al. |
| 2009/0253634 | A1 | | 10/2009 | Currie et al. |

FOREIGN PATENT DOCUMENTS

| WO | WO 99/09416 A2    | 2/1999 |
| WO | WO2004071436 A2   | 2/2004 |
| WO | WO 2004071436 A2 *| 8/2004 |
| WO | WO2005087797 A1   | 9/2005 |

OTHER PUBLICATIONS

The Mayo Clinic Colon Cancer Symptoms—http://www.mayoclinic.com/health/colon-cancer/DS00035/DSECTION=symptoms, last visited Jun. 24, 2013.*
McMillan, Assessing and Managing Opiate-Induced Constipation in Adults with Cancer, Cancer Control, vol. 11, Supp. 1, No. 3, May/Jun. 2004.*
Lussier Adjuvant Analgesics in Cancer Pain, The Oncologist, vol. 9, pp. 571-591, 2004.*
Wolfe, H.R., et al., "A comparative molecular field analysis (COMFA) of the structural determinants of heat-stable enterotoxins mediating activation of guanylyl cyclase C.", J. of Med. Chem. vol. 45(8):1731-1734, Apr. 11, 2002.
Kubota, H., et al., "A Long-acting Heat-stable Enterotoxin Analog of Enterotoxigenic *Escherichia coli* with a Single D-Amino Acid.", Biochem. and BioPhys. Research Communications vol. 161(1):229-235, May 30, 1989.

* cited by examiner

*Primary Examiner* — James H Alstrum Acevedo
*Assistant Examiner* — Jeanette Lieb
(74) *Attorney, Agent, or Firm* — Honigman Miller Schwartz & Cohn; Kelly T. Murphy; Jonathan P. O'Brien

(57) ABSTRACT

Peptides that act as GC-C receptor agonists and contain at least one D-cys and are useful for the treatment of diuresis and heart disease as well as other disorders are described.

1 Claim, 64 Drawing Sheets

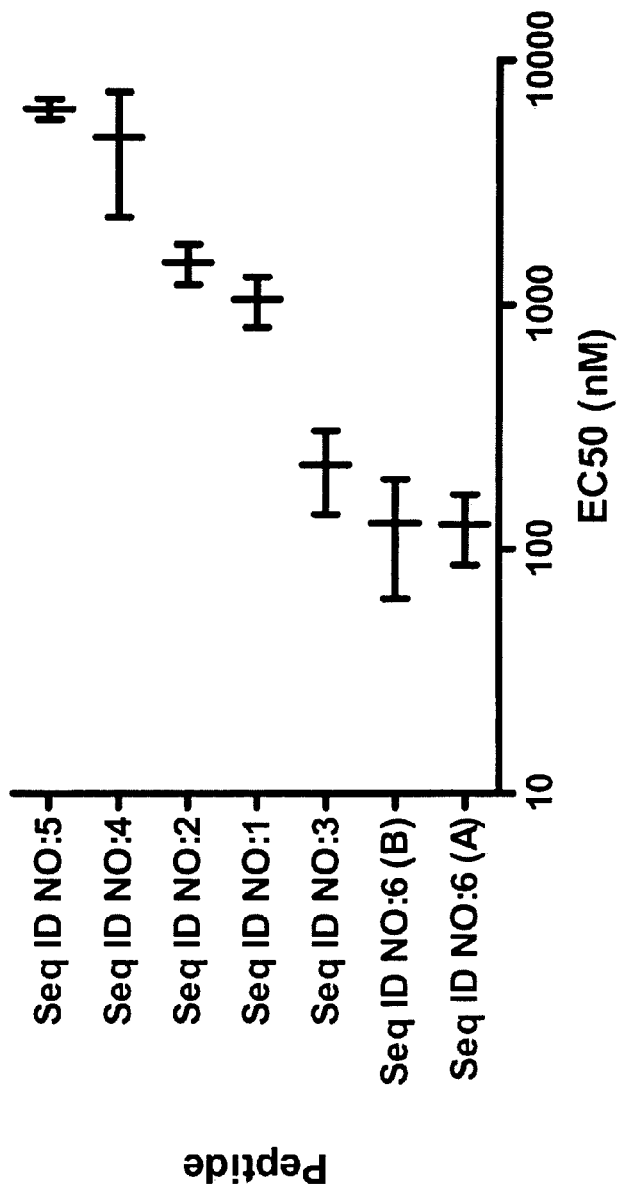

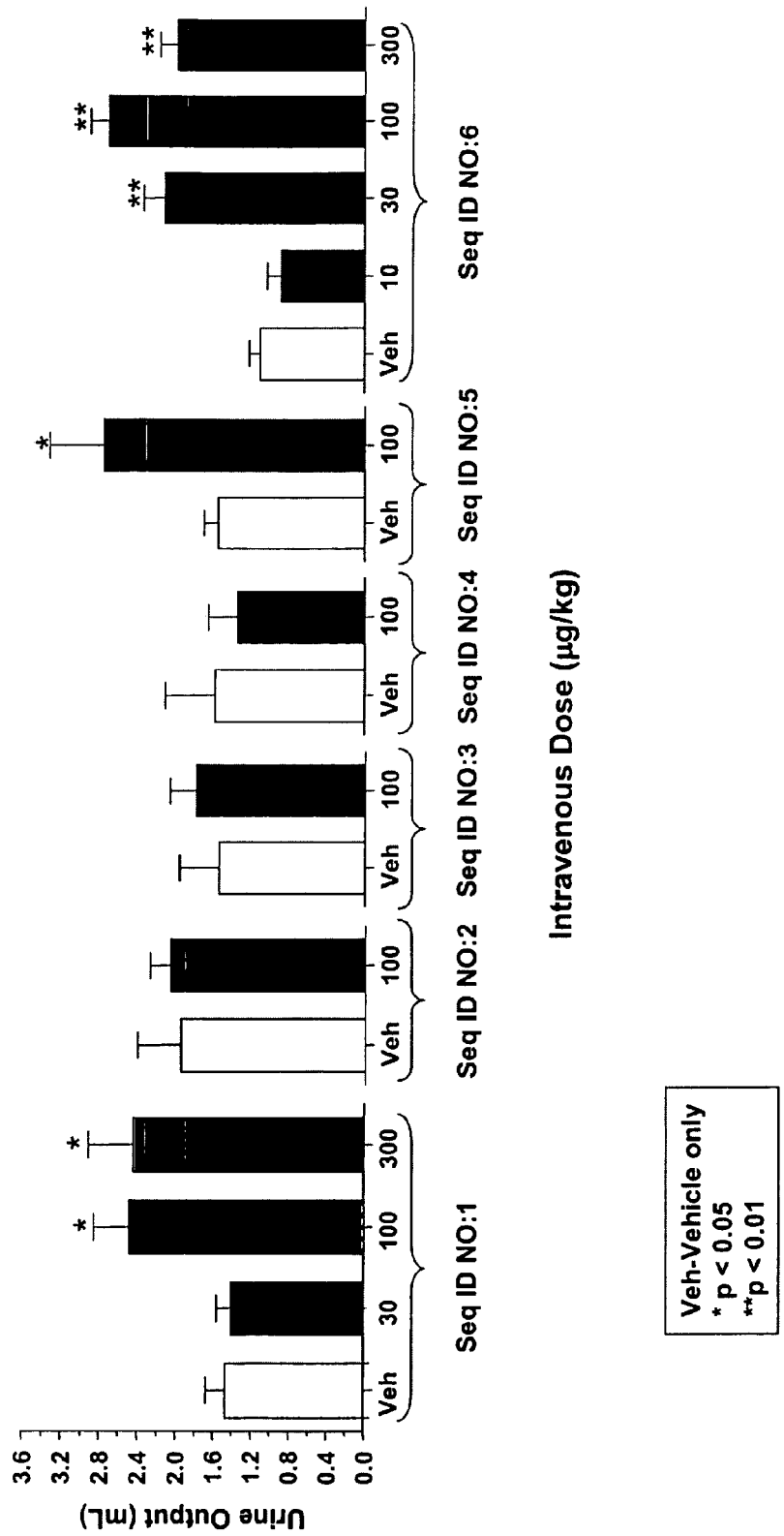

| | | | | | | | | | | | | | | |
|---|---|---|---|---|---|---|---|---|---|---|---|---|---|---|
| — | — | Cys | Cys | Glu | Val | Cys | Cys | Asn | Pro | Ala | Cys | Thr | Gly | D-Cys | Lys |
| — | — | Cys | Cys | Glu | Val | Cys | Cys | Asn | Pro | Ala | Cys | Thr | Gly | D-Cys | Tyr |
| — | — | Cys | Cys | Glu | Val | Cys | Cys | Thr | Pro | Ala | Cys | Thr | Gly | Cys | — |
| — | — | Cys | Cys | Glu | Val | Cys | Cys | Thr | Pro | Ala | Cys | Thr | Gly | Cys | Lys |
| — | — | Cys | Cys | Glu | Val | Cys | Cys | Thr | Pro | Ala | Cys | Thr | Gly | Cys | Tyr |
| — | — | Cys | Cys | Glu | Val | Cys | Cys | Thr | Pro | Ala | Cys | Thr | Gly | D-Cys | — |
| — | — | Cys | Cys | Glu | Val | Cys | Cys | Thr | Pro | Ala | Cys | Thr | Gly | D-Cys | Lys |
| — | — | Cys | Cys | Glu | Val | Cys | Cys | Thr | Pro | Ala | Cys | Thr | Gly | D-Cys | Tyr |
| — | — | Cys | Cys | Glu | Val | D-Cys | Cys | Asn | Pro | Ala | Cys | Thr | Gly | Cys | — |
| — | — | Cys | Cys | Glu | Val | D-Cys | Cys | Asn | Pro | Ala | Cys | Thr | Gly | Cys | Lys |
| — | — | Cys | Cys | Glu | Val | D-Cys | Cys | Asn | Pro | Ala | Cys | Thr | Gly | Cys | Tyr |
| — | — | Cys | Cys | Glu | Val | D-Cys | Cys | Asn | Pro | Ala | Cys | Thr | Gly | D-Cys | — |
| — | — | Cys | Cys | Glu | Val | D-Cys | Cys | Asn | Pro | Ala | Cys | Thr | Gly | D-Cys | Lys |
| — | — | Cys | Cys | Glu | Val | D-Cys | Cys | Asn | Pro | Ala | Cys | Thr | Gly | D-Cys | Tyr |
| — | — | Cys | Cys | Glu | Val | D-Cys | Cys | Thr | Pro | Ala | Cys | Thr | Gly | Cys | — |
| — | — | Cys | Cys | Glu | Val | D-Cys | Cys | Thr | Pro | Ala | Cys | Thr | Gly | Cys | Lys |
| — | — | Cys | Cys | Glu | Val | D-Cys | Cys | Thr | Pro | Ala | Cys | Thr | Gly | Cys | Tyr |
| — | — | Cys | Cys | Glu | Val | D-Cys | Cys | Thr | Pro | Ala | Cys | Thr | Gly | D-Cys | — |
| — | — | Cys | Cys | Glu | Val | D-Cys | Cys | Thr | Pro | Ala | Cys | Thr | Gly | D-Cys | Lys |
| — | — | Cys | Cys | Glu | Val | D-Cys | Cys | Thr | Pro | Ala | Cys | Thr | Gly | D-Cys | Tyr |
| — | — | Cys | Cys | Glu | Ile | Cys | Cys | Asn | Pro | Ala | Cys | Thr | Gly | Cys | — |
| — | — | Cys | Cys | Glu | Ile | Cys | Cys | Asn | Pro | Ala | Cys | Thr | Gly | Cys | Lys |
| — | — | Cys | Cys | Glu | Ile | Cys | Cys | Asn | Pro | Ala | Cys | Thr | Gly | Cys | Tyr |
| — | — | Cys | Cys | Glu | Ile | Cys | Cys | Asn | Pro | Ala | Cys | Thr | Gly | D-Cys | — |
| — | — | Cys | Cys | Glu | Ile | Cys | Cys | Asn | Pro | Ala | Cys | Thr | Gly | D-Cys | Lys |
| — | — | Cys | Cys | Glu | Ile | Cys | Cys | Asn | Pro | Ala | Cys | Thr | Gly | D-Cys | Tyr |
| — | — | Cys | Cys | Glu | Ile | Cys | Cys | Thr | Pro | Ala | Cys | Thr | Gly | Cys | — |
| — | — | Cys | Cys | Glu | Ile | Cys | Cys | Thr | Pro | Ala | Cys | Thr | Gly | Cys | Lys |
| — | — | Cys | Cys | Glu | Ile | Cys | Cys | Thr | Pro | Ala | Cys | Thr | Gly | Cys | Tyr |
| — | — | Cys | Cys | Glu | Ile | Cys | Cys | Thr | Pro | Ala | Cys | Thr | Gly | D-Cys | — |
| — | — | Cys | Cys | Glu | Ile | Cys | Cys | Thr | Pro | Ala | Cys | Thr | Gly | D-Cys | Lys |
| — | — | Cys | Cys | Glu | Ile | Cys | Cys | Thr | Pro | Ala | Cys | Thr | Gly | D-Cys | Tyr |
| — | — | Cys | Cys | Glu | Ile | D-Cys | Cys | Asn | Pro | Ala | Cys | Thr | Gly | Cys | — |
| — | — | Cys | Cys | Glu | Ile | D-Cys | Cys | Asn | Pro | Ala | Cys | Thr | Gly | Cys | Lys |
| — | — | Cys | Cys | Glu | Ile | D-Cys | Cys | Asn | Pro | Ala | Cys | Thr | Gly | Cys | Tyr |
| — | — | Cys | Cys | Glu | Ile | D-Cys | Cys | Asn | Pro | Ala | Cys | Thr | Gly | D-Cys | — |
| — | — | Cys | Cys | Glu | Ile | D-Cys | Cys | Asn | Pro | Ala | Cys | Thr | Gly | D-Cys | Lys |
| — | — | Cys | Cys | Glu | Ile | D-Cys | Cys | Asn | Pro | Ala | Cys | Thr | Gly | D-Cys | Tyr |
| — | — | Cys | Cys | Glu | Ile | D-Cys | Cys | Thr | Pro | Ala | Cys | Thr | Gly | Cys | — |
| — | — | Cys | Cys | Glu | Ile | D-Cys | Cys | Thr | Pro | Ala | Cys | Thr | Gly | Cys | Lys |
| — | — | Cys | Cys | Glu | Ile | D-Cys | Cys | Thr | Pro | Ala | Cys | Thr | Gly | Cys | Tyr |
| — | — | Cys | Cys | Glu | Ile | D-Cys | Cys | Thr | Pro | Ala | Cys | Thr | Gly | D-Cys | — |
| — | — | Cys | Cys | Glu | Ile | D-Cys | Cys | Thr | Pro | Ala | Cys | Thr | Gly | D-Cys | Lys |
| — | — | Cys | Cys | Glu | Ile | D-Cys | Cys | Thr | Pro | Ala | Cys | Thr | Gly | D-Cys | Tyr |
| — | — | Cys | Cys | Glu | Leu | Cys | Cys | Asn | Pro | Ala | Cys | Thr | Gly | Cys | — |
| — | — | Cys | Cys | Glu | Leu | Cys | Cys | Asn | Pro | Ala | Cys | Thr | Gly | Cys | Lys |
| — | — | Cys | Cys | Glu | Leu | Cys | Cys | Asn | Pro | Ala | Cys | Thr | Gly | Cys | Tyr |
| — | — | Cys | Cys | Glu | Leu | Cys | Cys | Asn | Pro | Ala | Cys | Thr | Gly | D-Cys | — |
| — | — | Cys | Cys | Glu | Leu | Cys | Cys | Asn | Pro | Ala | Cys | Thr | Gly | D-Cys | Lys |
| — | — | Cys | Cys | Glu | Leu | Cys | Cys | Asn | Pro | Ala | Cys | Thr | Gly | D-Cys | Tyr |
| — | — | Cys | Cys | Glu | Leu | Cys | Cys | Thr | Pro | Ala | Cys | Thr | Gly | Cys | — |
| — | — | Cys | Cys | Glu | Leu | Cys | Cys | Thr | Pro | Ala | Cys | Thr | Gly | Cys | Lys |
| — | — | Cys | Cys | Glu | Leu | Cys | Cys | Thr | Pro | Ala | Cys | Thr | Gly | Cys | Tyr |
| — | — | Cys | Cys | Glu | Leu | Cys | Cys | Thr | Pro | Ala | Cys | Thr | Gly | D-Cys | — |
| — | — | Cys | Cys | Glu | Leu | Cys | Cys | Thr | Pro | Ala | Cys | Thr | Gly | D-Cys | Lys |
| — | — | Cys | Cys | Glu | Leu | Cys | Cys | Thr | Pro | Ala | Cys | Thr | Gly | D-Cys | Tyr |
| — | — | Cys | Cys | Glu | Leu | D-Cys | Cys | Asn | Pro | Ala | Cys | Thr | Gly | Cys | — |
| — | — | Cys | Cys | Glu | Leu | D-Cys | Cys | Asn | Pro | Ala | Cys | Thr | Gly | Cys | Lys |
| — | — | Cys | Cys | Glu | Leu | D-Cys | Cys | Asn | Pro | Ala | Cys | Thr | Gly | Cys | Tyr |

FIG. 3A-1

| | | | | | | | | | | | | | |
|---|---|---|---|---|---|---|---|---|---|---|---|---|---|
| — | — | Cys | Cys | Glu | Leu | D-Cys | Cys | Asn | Pro | Ala | Cys | Thr | Gly | D-Cys | — |
| — | — | Cys | Cys | Glu | Leu | D-Cys | Cys | Asn | Pro | Ala | Cys | Thr | Gly | D-Cys | Lys |
| — | — | Cys | Cys | Glu | Leu | D-Cys | Cys | Asn | Pro | Ala | Cys | Thr | Gly | D-Cys | Tyr |
| — | — | Cys | Cys | Glu | Leu | D-Cys | Cys | Thr | Pro | Ala | Cys | Thr | Gly | Cys | — |
| — | — | Cys | Cys | Glu | Leu | D-Cys | Cys | Thr | Pro | Ala | Cys | Thr | Gly | Cys | Lys |
| — | — | Cys | Cys | Glu | Leu | D-Cys | Cys | Thr | Pro | Ala | Cys | Thr | Gly | Cys | Tyr |
| — | — | Cys | Cys | Glu | Leu | D-Cys | Cys | Thr | Pro | Ala | Cys | Thr | Gly | D-Cys | — |
| — | — | Cys | Cys | Glu | Leu | D-Cys | Cys | Thr | Pro | Ala | Cys | Thr | Gly | D-Cys | Lys |
| — | — | Cys | Cys | Glu | Leu | D-Cys | Cys | Thr | Pro | Ala | Cys | Thr | Gly | D-Cys | Tyr |
| — | — | Cys | Cys | Glu | Tyr | Cys | Cys | Asn | Pro | Ala | Cys | Thr | Gly | Cys | — |
| — | — | Cys | Cys | Glu | Tyr | Cys | Cys | Asn | Pro | Ala | Cys | Thr | Gly | Cys | Lys |
| — | — | Cys | Cys | Glu | Tyr | Cys | Cys | Asn | Pro | Ala | Cys | Thr | Gly | Cys | Tyr |
| — | — | Cys | Cys | Glu | Tyr | Cys | Cys | Asn | Pro | Ala | Cys | Thr | Gly | D-Cys | — |
| — | — | Cys | Cys | Glu | Tyr | Cys | Cys | Asn | Pro | Ala | Cys | Thr | Gly | D-Cys | Lys |
| — | — | Cys | Cys | Glu | Tyr | Cys | Cys | Asn | Pro | Ala | Cys | Thr | Gly | D-Cys | Tyr |
| — | — | Cys | Cys | Glu | Tyr | Cys | Cys | Thr | Pro | Ala | Cys | Thr | Gly | Cys | — |
| — | — | Cys | Cys | Glu | Tyr | Cys | Cys | Thr | Pro | Ala | Cys | Thr | Gly | Cys | Lys |
| — | — | Cys | Cys | Glu | Tyr | Cys | Cys | Thr | Pro | Ala | Cys | Thr | Gly | Cys | Tyr |
| — | — | Cys | Cys | Glu | Tyr | Cys | Cys | Thr | Pro | Ala | Cys | Thr | Gly | D-Cys | — |
| — | — | Cys | Cys | Glu | Tyr | Cys | Cys | Thr | Pro | Ala | Cys | Thr | Gly | D-Cys | Lys |
| — | — | Cys | Cys | Glu | Tyr | Cys | Cys | Thr | Pro | Ala | Cys | Thr | Gly | D-Cys | Tyr |
| — | — | Cys | Cys | Glu | Tyr | D-Cys | Cys | Asn | Pro | Ala | Cys | Thr | Gly | Cys | — |
| — | — | Cys | Cys | Glu | Tyr | D-Cys | Cys | Asn | Pro | Ala | Cys | Thr | Gly | Cys | Lys |
| — | — | Cys | Cys | Glu | Tyr | D-Cys | Cys | Asn | Pro | Ala | Cys | Thr | Gly | Cys | Tyr |
| — | — | Cys | Cys | Glu | Tyr | D-Cys | Cys | Asn | Pro | Ala | Cys | Thr | Gly | D-Cys | — |
| — | — | Cys | Cys | Glu | Tyr | D-Cys | Cys | Asn | Pro | Ala | Cys | Thr | Gly | D-Cys | Lys |
| — | — | Cys | Cys | Glu | Tyr | D-Cys | Cys | Asn | Pro | Ala | Cys | Thr | Gly | D-Cys | Tyr |
| — | — | Cys | Cys | Glu | Tyr | D-Cys | Cys | Thr | Pro | Ala | Cys | Thr | Gly | Cys | — |
| — | — | Cys | Cys | Glu | Tyr | D-Cys | Cys | Thr | Pro | Ala | Cys | Thr | Gly | Cys | Lys |
| — | — | Cys | Cys | Glu | Tyr | D-Cys | Cys | Thr | Pro | Ala | Cys | Thr | Gly | Cys | Tyr |
| — | — | Cys | Cys | Glu | Tyr | D-Cys | Cys | Thr | Pro | Ala | Cys | Thr | Gly | D-Cys | — |
| — | — | Cys | Cys | Glu | Tyr | D-Cys | Cys | Thr | Pro | Ala | Cys | Thr | Gly | D-Cys | Lys |
| — | — | Cys | Cys | Glu | Tyr | D-Cys | Cys | Thr | Pro | Ala | Cys | Thr | Gly | D-Cys | Tyr |
| — | — | Cys | Cys | Glu | Phe | Cys | Cys | Asn | Pro | Ala | Cys | Thr | Gly | Cys | — |
| — | — | Cys | Cys | Glu | Phe | Cys | Cys | Asn | Pro | Ala | Cys | Thr | Gly | Cys | Lys |
| — | — | Cys | Cys | Glu | Phe | Cys | Cys | Asn | Pro | Ala | Cys | Thr | Gly | Cys | Tyr |
| — | — | Cys | Cys | Glu | Phe | Cys | Cys | Asn | Pro | Ala | Cys | Thr | Gly | D-Cys | — |
| — | — | Cys | Cys | Glu | Phe | Cys | Cys | Asn | Pro | Ala | Cys | Thr | Gly | D-Cys | Lys |
| — | — | Cys | Cys | Glu | Phe | Cys | Cys | Asn | Pro | Ala | Cys | Thr | Gly | D-Cys | Tyr |
| — | — | Cys | Cys | Glu | Phe | Cys | Cys | Thr | Pro | Ala | Cys | Thr | Gly | Cys | — |
| — | — | Cys | Cys | Glu | Phe | Cys | Cys | Thr | Pro | Ala | Cys | Thr | Gly | Cys | Lys |
| — | — | Cys | Cys | Glu | Phe | Cys | Cys | Thr | Pro | Ala | Cys | Thr | Gly | Cys | Tyr |
| — | — | Cys | Cys | Glu | Phe | Cys | Cys | Thr | Pro | Ala | Cys | Thr | Gly | D-Cys | — |
| — | — | Cys | Cys | Glu | Phe | Cys | Cys | Thr | Pro | Ala | Cys | Thr | Gly | D-Cys | Lys |
| — | — | Cys | Cys | Glu | Phe | Cys | Cys | Thr | Pro | Ala | Cys | Thr | Gly | D-Cys | Tyr |
| — | — | Cys | Cys | Glu | Phe | D-Cys | Cys | Asn | Pro | Ala | Cys | Thr | Gly | Cys | — |
| — | — | Cys | Cys | Glu | Phe | D-Cys | Cys | Asn | Pro | Ala | Cys | Thr | Gly | Cys | Lys |
| — | — | Cys | Cys | Glu | Phe | D-Cys | Cys | Asn | Pro | Ala | Cys | Thr | Gly | Cys | Tyr |
| — | — | Cys | Cys | Glu | Phe | D-Cys | Cys | Asn | Pro | Ala | Cys | Thr | Gly | D-Cys | — |
| — | — | Cys | Cys | Glu | Phe | D-Cys | Cys | Asn | Pro | Ala | Cys | Thr | Gly | D-Cys | Lys |
| — | — | Cys | Cys | Glu | Phe | D-Cys | Cys | Asn | Pro | Ala | Cys | Thr | Gly | D-Cys | Tyr |
| — | — | Cys | Cys | Glu | Phe | D-Cys | Cys | Thr | Pro | Ala | Cys | Thr | Gly | Cys | — |
| — | — | Cys | Cys | Glu | Phe | D-Cys | Cys | Thr | Pro | Ala | Cys | Thr | Gly | Cys | Lys |
| — | — | Cys | Cys | Glu | Phe | D-Cys | Cys | Thr | Pro | Ala | Cys | Thr | Gly | Cys | Tyr |
| — | — | Cys | Cys | Glu | Phe | D-Cys | Cys | Thr | Pro | Ala | Cys | Thr | Gly | D-Cys | — |
| — | — | Cys | Cys | Glu | Phe | D-Cys | Cys | Thr | Pro | Ala | Cys | Thr | Gly | D-Cys | Lys |
| — | — | Cys | Cys | Glu | Phe | D-Cys | Cys | Thr | Pro | Ala | Cys | Thr | Gly | D-Cys | Tyr |
| — | — | Cys | Cys | Glu | Trp | Cys | Cys | Asn | Pro | Ala | Cys | Thr | Gly | Cys | — |
| — | — | Cys | Cys | Glu | Trp | Cys | Cys | Asn | Pro | Ala | Cys | Thr | Gly | Cys | Lys |
| — | — | Cys | Cys | Glu | Trp | Cys | Cys | Asn | Pro | Ala | Cys | Thr | Gly | Cys | Tyr |

FIG. 3A-2

| | | | | | | | | | | | | | | |
|---|---|---|---|---|---|---|---|---|---|---|---|---|---|---|
| — | — | Cys | Cys | Glu | Trp | Cys | Cys | Asn | Pro | Ala | Cys | Thr | Gly | D-Cys | — |
| — | — | Cys | Cys | Glu | Trp | Cys | Cys | Asn | Pro | Ala | Cys | Thr | Gly | D-Cys | Lys |
| — | — | Cys | Cys | Glu | Trp | Cys | Cys | Asn | Pro | Ala | Cys | Thr | Gly | D-Cys | Tyr |
| — | — | Cys | Cys | Glu | Trp | Cys | Cys | Thr | Pro | Ala | Cys | Thr | Gly | Cys | — |
| — | — | Cys | Cys | Glu | Trp | Cys | Cys | Thr | Pro | Ala | Cys | Thr | Gly | Cys | Lys |
| — | — | Cys | Cys | Glu | Trp | Cys | Cys | Thr | Pro | Ala | Cys | Thr | Gly | Cys | Tyr |
| — | — | Cys | Cys | Glu | Trp | Cys | Cys | Thr | Pro | Ala | Cys | Thr | Gly | D-Cys | — |
| — | — | Cys | Cys | Glu | Trp | Cys | Cys | Thr | Pro | Ala | Cys | Thr | Gly | D-Cys | Lys |
| — | — | Cys | Cys | Glu | Trp | Cys | Cys | Thr | Pro | Ala | Cys | Thr | Gly | D-Cys | Tyr |
| — | — | Cys | Cys | Glu | Trp | D-Cys | Cys | Asn | Pro | Ala | Cys | Thr | Gly | Cys | — |
| — | — | Cys | Cys | Glu | Trp | D-Cys | Cys | Asn | Pro | Ala | Cys | Thr | Gly | Cys | Lys |
| — | — | Cys | Cys | Glu | Trp | D-Cys | Cys | Asn | Pro | Ala | Cys | Thr | Gly | Cys | Tyr |
| — | — | Cys | Cys | Glu | Trp | D-Cys | Cys | Asn | Pro | Ala | Cys | Thr | Gly | D-Cys | — |
| — | — | Cys | Cys | Glu | Trp | D-Cys | Cys | Asn | Pro | Ala | Cys | Thr | Gly | D-Cys | Lys |
| — | — | Cys | Cys | Glu | Trp | D-Cys | Cys | Asn | Pro | Ala | Cys | Thr | Gly | D-Cys | Tyr |
| — | — | Cys | Cys | Glu | Trp | D-Cys | Cys | Thr | Pro | Ala | Cys | Thr | Gly | Cys | — |
| — | — | Cys | Cys | Glu | Trp | D-Cys | Cys | Thr | Pro | Ala | Cys | Thr | Gly | Cys | Lys |
| — | — | Cys | Cys | Glu | Trp | D-Cys | Cys | Thr | Pro | Ala | Cys | Thr | Gly | Cys | Tyr |
| — | — | Cys | Cys | Glu | Trp | D-Cys | Cys | Thr | Pro | Ala | Cys | Thr | Gly | D-Cys | — |
| — | — | Cys | Cys | Glu | Trp | D-Cys | Cys | Thr | Pro | Ala | Cys | Thr | Gly | D-Cys | Lys |
| — | — | Cys | Cys | Glu | Trp | D-Cys | Cys | Thr | Pro | Ala | Cys | Thr | Gly | D-Cys | Tyr |
| — | — | D-Cys | Cys | Glu | Val | Cys | Cys | Asn | Pro | Ala | Cys | Thr | Gly | Cys | — |
| — | — | D-Cys | Cys | Glu | Val | Cys | Cys | Asn | Pro | Ala | Cys | Thr | Gly | Cys | Lys |
| — | — | D-Cys | Cys | Glu | Val | Cys | Cys | Asn | Pro | Ala | Cys | Thr | Gly | Cys | Tyr |
| — | — | D-Cys | Cys | Glu | Val | Cys | Cys | Asn | Pro | Ala | Cys | Thr | Gly | D-Cys | — |
| — | — | D-Cys | Cys | Glu | Val | Cys | Cys | Asn | Pro | Ala | Cys | Thr | Gly | D-Cys | Lys |
| — | — | D-Cys | Cys | Glu | Val | Cys | Cys | Asn | Pro | Ala | Cys | Thr | Gly | D-Cys | Tyr |
| — | — | D-Cys | Cys | Glu | Val | Cys | Cys | Thr | Pro | Ala | Cys | Thr | Gly | Cys | — |
| — | — | D-Cys | Cys | Glu | Val | Cys | Cys | Thr | Pro | Ala | Cys | Thr | Gly | Cys | Lys |
| — | — | D-Cys | Cys | Glu | Val | Cys | Cys | Thr | Pro | Ala | Cys | Thr | Gly | Cys | Tyr |
| — | — | D-Cys | Cys | Glu | Val | Cys | Cys | Thr | Pro | Ala | Cys | Thr | Gly | D-Cys | — |
| — | — | D-Cys | Cys | Glu | Val | Cys | Cys | Thr | Pro | Ala | Cys | Thr | Gly | D-Cys | Lys |
| — | — | D-Cys | Cys | Glu | Val | Cys | Cys | Thr | Pro | Ala | Cys | Thr | Gly | D-Cys | Tyr |
| — | — | D-Cys | Cys | Glu | Val | D-Cys | Cys | Asn | Pro | Ala | Cys | Thr | Gly | Cys | — |
| — | — | D-Cys | Cys | Glu | Val | D-Cys | Cys | Asn | Pro | Ala | Cys | Thr | Gly | Cys | Lys |
| — | — | D-Cys | Cys | Glu | Val | D-Cys | Cys | Asn | Pro | Ala | Cys | Thr | Gly | Cys | Tyr |
| — | — | D-Cys | Cys | Glu | Val | D-Cys | Cys | Asn | Pro | Ala | Cys | Thr | Gly | D-Cys | — |
| — | — | D-Cys | Cys | Glu | Val | D-Cys | Cys | Asn | Pro | Ala | Cys | Thr | Gly | D-Cys | Lys |
| — | — | D-Cys | Cys | Glu | Val | D-Cys | Cys | Asn | Pro | Ala | Cys | Thr | Gly | D-Cys | Tyr |
| — | — | D-Cys | Cys | Glu | Val | D-Cys | Cys | Thr | Pro | Ala | Cys | Thr | Gly | Cys | — |
| — | — | D-Cys | Cys | Glu | Val | D-Cys | Cys | Thr | Pro | Ala | Cys | Thr | Gly | Cys | Lys |
| — | — | D-Cys | Cys | Glu | Val | D-Cys | Cys | Thr | Pro | Ala | Cys | Thr | Gly | Cys | Tyr |
| — | — | D-Cys | Cys | Glu | Val | D-Cys | Cys | Thr | Pro | Ala | Cys | Thr | Gly | D-Cys | — |
| — | — | D-Cys | Cys | Glu | Val | D-Cys | Cys | Thr | Pro | Ala | Cys | Thr | Gly | D-Cys | Lys |
| — | — | D-Cys | Cys | Glu | Val | D-Cys | Cys | Thr | Pro | Ala | Cys | Thr | Gly | D-Cys | Tyr |
| — | — | D-Cys | Cys | Glu | Ile | Cys | Cys | Asn | Pro | Ala | Cys | Thr | Gly | Cys | — |
| — | — | D-Cys | Cys | Glu | Ile | Cys | Cys | Asn | Pro | Ala | Cys | Thr | Gly | Cys | Lys |
| — | — | D-Cys | Cys | Glu | Ile | Cys | Cys | Asn | Pro | Ala | Cys | Thr | Gly | Cys | Tyr |
| — | — | D-Cys | Cys | Glu | Ile | Cys | Cys | Asn | Pro | Ala | Cys | Thr | Gly | D-Cys | — |
| — | — | D-Cys | Cys | Glu | Ile | Cys | Cys | Asn | Pro | Ala | Cys | Thr | Gly | D-Cys | Lys |
| — | — | D-Cys | Cys | Glu | Ile | Cys | Cys | Asn | Pro | Ala | Cys | Thr | Gly | D-Cys | Tyr |
| — | — | D-Cys | Cys | Glu | Ile | Cys | Cys | Thr | Pro | Ala | Cys | Thr | Gly | Cys | — |
| — | — | D-Cys | Cys | Glu | Ile | Cys | Cys | Thr | Pro | Ala | Cys | Thr | Gly | Cys | Lys |
| — | — | D-Cys | Cys | Glu | Ile | Cys | Cys | Thr | Pro | Ala | Cys | Thr | Gly | Cys | Tyr |
| — | — | D-Cys | Cys | Glu | Ile | Cys | Cys | Thr | Pro | Ala | Cys | Thr | Gly | D-Cys | — |
| — | — | D-Cys | Cys | Glu | Ile | Cys | Cys | Thr | Pro | Ala | Cys | Thr | Gly | D-Cys | Lys |
| — | — | D-Cys | Cys | Glu | Ile | Cys | Cys | Thr | Pro | Ala | Cys | Thr | Gly | D-Cys | Tyr |
| — | — | D-Cys | Cys | Glu | Ile | D-Cys | Cys | Asn | Pro | Ala | Cys | Thr | Gly | Cys | — |
| — | — | D-Cys | Cys | Glu | Ile | D-Cys | Cys | Asn | Pro | Ala | Cys | Thr | Gly | Cys | Lys |
| — | — | D-Cys | Cys | Glu | Ile | D-Cys | Cys | Asn | Pro | Ala | Cys | Thr | Gly | Cys | Tyr |

FIG. 3A-3

| | | | | | | | | | | | | | |
|---|---|---|---|---|---|---|---|---|---|---|---|---|---|
| — | — | D-Cys | Cys | Glu | Ile | D-Cys | Cys | Asn | Pro | Ala | Cys | Thr | Gly | D-Cys | — |
| — | — | D-Cys | Cys | Glu | Ile | D-Cys | Cys | Asn | Pro | Ala | Cys | Thr | Gly | D-Cys | Lys |
| — | — | D-Cys | Cys | Glu | Ile | D-Cys | Cys | Asn | Pro | Ala | Cys | Thr | Gly | D-Cys | Tyr |
| — | — | D-Cys | Cys | Glu | Ile | D-Cys | Cys | Thr | Pro | Ala | Cys | Thr | Gly | Cys | — |
| — | — | D-Cys | Cys | Glu | Ile | D-Cys | Cys | Thr | Pro | Ala | Cys | Thr | Gly | Cys | Lys |
| — | — | D-Cys | Cys | Glu | Ile | D-Cys | Cys | Thr | Pro | Ala | Cys | Thr | Gly | Cys | Tyr |
| — | — | D-Cys | Cys | Glu | Ile | D-Cys | Cys | Thr | Pro | Ala | Cys | Thr | Gly | D-Cys | — |
| — | — | D-Cys | Cys | Glu | Ile | D-Cys | Cys | Thr | Pro | Ala | Cys | Thr | Gly | D-Cys | Lys |
| — | — | D-Cys | Cys | Glu | Ile | D-Cys | Cys | Thr | Pro | Ala | Cys | Thr | Gly | D-Cys | Tyr |
| — | — | D-Cys | Cys | Glu | Leu | Cys | Cys | Asn | Pro | Ala | Cys | Thr | Gly | Cys | — |
| — | — | D-Cys | Cys | Glu | Leu | Cys | Cys | Asn | Pro | Ala | Cys | Thr | Gly | Cys | Lys |
| — | — | D-Cys | Cys | Glu | Leu | Cys | Cys | Asn | Pro | Ala | Cys | Thr | Gly | Cys | Tyr |
| — | — | D-Cys | Cys | Glu | Leu | Cys | Cys | Asn | Pro | Ala | Cys | Thr | Gly | D-Cys | — |
| — | — | D-Cys | Cys | Glu | Leu | Cys | Cys | Asn | Pro | Ala | Cys | Thr | Gly | D-Cys | Lys |
| — | — | D-Cys | Cys | Glu | Leu | Cys | Cys | Asn | Pro | Ala | Cys | Thr | Gly | D-Cys | Tyr |
| — | — | D-Cys | Cys | Glu | Leu | Cys | Cys | Thr | Pro | Ala | Cys | Thr | Gly | Cys | — |
| — | — | D-Cys | Cys | Glu | Leu | Cys | Cys | Thr | Pro | Ala | Cys | Thr | Gly | Cys | Lys |
| — | — | D-Cys | Cys | Glu | Leu | Cys | Cys | Thr | Pro | Ala | Cys | Thr | Gly | Cys | Tyr |
| — | — | D-Cys | Cys | Glu | Leu | Cys | Cys | Thr | Pro | Ala | Cys | Thr | Gly | D-Cys | — |
| — | — | D-Cys | Cys | Glu | Leu | Cys | Cys | Thr | Pro | Ala | Cys | Thr | Gly | D-Cys | Lys |
| — | — | D-Cys | Cys | Glu | Leu | Cys | Cys | Thr | Pro | Ala | Cys | Thr | Gly | D-Cys | Tyr |
| — | — | D-Cys | Cys | Glu | Leu | D-Cys | Cys | Asn | Pro | Ala | Cys | Thr | Gly | Cys | — |
| — | — | D-Cys | Cys | Glu | Leu | D-Cys | Cys | Asn | Pro | Ala | Cys | Thr | Gly | Cys | Lys |
| — | — | D-Cys | Cys | Glu | Leu | D-Cys | Cys | Asn | Pro | Ala | Cys | Thr | Gly | Cys | Tyr |
| — | — | D-Cys | Cys | Glu | Leu | D-Cys | Cys | Asn | Pro | Ala | Cys | Thr | Gly | D-Cys | — |
| — | — | D-Cys | Cys | Glu | Leu | D-Cys | Cys | Asn | Pro | Ala | Cys | Thr | Gly | D-Cys | Lys |
| — | — | D-Cys | Cys | Glu | Leu | D-Cys | Cys | Asn | Pro | Ala | Cys | Thr | Gly | D-Cys | Tyr |
| — | — | D-Cys | Cys | Glu | Leu | D-Cys | Cys | Thr | Pro | Ala | Cys | Thr | Gly | Cys | — |
| — | — | D-Cys | Cys | Glu | Leu | D-Cys | Cys | Thr | Pro | Ala | Cys | Thr | Gly | Cys | Lys |
| — | — | D-Cys | Cys | Glu | Leu | D-Cys | Cys | Thr | Pro | Ala | Cys | Thr | Gly | Cys | Tyr |
| — | — | D-Cys | Cys | Glu | Leu | D-Cys | Cys | Thr | Pro | Ala | Cys | Thr | Gly | D-Cys | — |
| — | — | D-Cys | Cys | Glu | Leu | D-Cys | Cys | Thr | Pro | Ala | Cys | Thr | Gly | D-Cys | Lys |
| — | — | D-Cys | Cys | Glu | Leu | D-Cys | Cys | Thr | Pro | Ala | Cys | Thr | Gly | D-Cys | Tyr |
| — | — | D-Cys | Cys | Glu | Tyr | Cys | Cys | Asn | Pro | Ala | Cys | Thr | Gly | Cys | — |
| — | — | D-Cys | Cys | Glu | Tyr | Cys | Cys | Asn | Pro | Ala | Cys | Thr | Gly | Cys | Lys |
| — | — | D-Cys | Cys | Glu | Tyr | Cys | Cys | Asn | Pro | Ala | Cys | Thr | Gly | Cys | Tyr |
| — | — | D-Cys | Cys | Glu | Tyr | Cys | Cys | Asn | Pro | Ala | Cys | Thr | Gly | D-Cys | — |
| — | — | D-Cys | Cys | Glu | Tyr | Cys | Cys | Asn | Pro | Ala | Cys | Thr | Gly | D-Cys | Lys |
| — | — | D-Cys | Cys | Glu | Tyr | Cys | Cys | Asn | Pro | Ala | Cys | Thr | Gly | D-Cys | Tyr |
| — | — | D-Cys | Cys | Glu | Tyr | Cys | Cys | Thr | Pro | Ala | Cys | Thr | Gly | Cys | — |
| — | — | D-Cys | Cys | Glu | Tyr | Cys | Cys | Thr | Pro | Ala | Cys | Thr | Gly | Cys | Lys |
| — | — | D-Cys | Cys | Glu | Tyr | Cys | Cys | Thr | Pro | Ala | Cys | Thr | Gly | Cys | Tyr |
| — | — | D-Cys | Cys | Glu | Tyr | Cys | Cys | Thr | Pro | Ala | Cys | Thr | Gly | D-Cys | — |
| — | — | D-Cys | Cys | Glu | Tyr | Cys | Cys | Thr | Pro | Ala | Cys | Thr | Gly | D-Cys | Lys |
| — | — | D-Cys | Cys | Glu | Tyr | Cys | Cys | Thr | Pro | Ala | Cys | Thr | Gly | D-Cys | Tyr |
| — | — | D-Cys | Cys | Glu | Tyr | D-Cys | Cys | Asn | Pro | Ala | Cys | Thr | Gly | Cys | — |
| — | — | D-Cys | Cys | Glu | Tyr | D-Cys | Cys | Asn | Pro | Ala | Cys | Thr | Gly | Cys | Lys |
| — | — | D-Cys | Cys | Glu | Tyr | D-Cys | Cys | Asn | Pro | Ala | Cys | Thr | Gly | Cys | Tyr |
| — | — | D-Cys | Cys | Glu | Tyr | D-Cys | Cys | Asn | Pro | Ala | Cys | Thr | Gly | D-Cys | — |
| — | — | D-Cys | Cys | Glu | Tyr | D-Cys | Cys | Asn | Pro | Ala | Cys | Thr | Gly | D-Cys | Lys |
| — | — | D-Cys | Cys | Glu | Tyr | D-Cys | Cys | Asn | Pro | Ala | Cys | Thr | Gly | D-Cys | Tyr |
| — | — | D-Cys | Cys | Glu | Tyr | D-Cys | Cys | Thr | Pro | Ala | Cys | Thr | Gly | Cys | — |
| — | — | D-Cys | Cys | Glu | Tyr | D-Cys | Cys | Thr | Pro | Ala | Cys | Thr | Gly | Cys | Lys |
| — | — | D-Cys | Cys | Glu | Tyr | D-Cys | Cys | Thr | Pro | Ala | Cys | Thr | Gly | Cys | Tyr |
| — | — | D-Cys | Cys | Glu | Tyr | D-Cys | Cys | Thr | Pro | Ala | Cys | Thr | Gly | D-Cys | — |
| — | — | D-Cys | Cys | Glu | Tyr | D-Cys | Cys | Thr | Pro | Ala | Cys | Thr | Gly | D-Cys | Lys |
| — | — | D-Cys | Cys | Glu | Tyr | D-Cys | Cys | Thr | Pro | Ala | Cys | Thr | Gly | D-Cys | Tyr |
| — | — | D-Cys | Cys | Glu | Phe | Cys | Cys | Asn | Pro | Ala | Cys | Thr | Gly | Cys | — |
| — | — | D-Cys | Cys | Glu | Phe | Cys | Cys | Asn | Pro | Ala | Cys | Thr | Gly | Cys | Lys |
| — | — | D-Cys | Cys | Glu | Phe | Cys | Cys | Asn | Pro | Ala | Cys | Thr | Gly | Cys | Tyr |

FIG. 3A-4

| | | | | | | | | | | | | | | |
|---|---|---|---|---|---|---|---|---|---|---|---|---|---|---|
| — | — | D-Cys | Cys | Glu | Phe | Cys | Cys | Asn | Pro | Ala | Cys | Thr | Gly | D-Cys | — |
| — | — | D-Cys | Cys | Glu | Phe | Cys | Cys | Asn | Pro | Ala | Cys | Thr | Gly | D-Cys | Lys |
| — | — | D-Cys | Cys | Glu | Phe | Cys | Cys | Asn | Pro | Ala | Cys | Thr | Gly | D-Cys | Tyr |
| — | — | D-Cys | Cys | Glu | Phe | Cys | Cys | Thr | Pro | Ala | Cys | Thr | Gly | Cys | — |
| — | — | D-Cys | Cys | Glu | Phe | Cys | Cys | Thr | Pro | Ala | Cys | Thr | Gly | Cys | Lys |
| — | — | D-Cys | Cys | Glu | Phe | Cys | Cys | Thr | Pro | Ala | Cys | Thr | Gly | Cys | Tyr |
| — | — | D-Cys | Cys | Glu | Phe | Cys | Cys | Thr | Pro | Ala | Cys | Thr | Gly | D-Cys | — |
| — | — | D-Cys | Cys | Glu | Phe | Cys | Cys | Thr | Pro | Ala | Cys | Thr | Gly | D-Cys | Lys |
| — | — | D-Cys | Cys | Glu | Phe | Cys | Cys | Thr | Pro | Ala | Cys | Thr | Gly | D-Cys | Tyr |
| — | — | D-Cys | Cys | Glu | Phe | D-Cys | Cys | Asn | Pro | Ala | Cys | Thr | Gly | Cys | — |
| — | — | D-Cys | Cys | Glu | Phe | D-Cys | Cys | Asn | Pro | Ala | Cys | Thr | Gly | Cys | Lys |
| — | — | D-Cys | Cys | Glu | Phe | D-Cys | Cys | Asn | Pro | Ala | Cys | Thr | Gly | Cys | Tyr |
| — | — | D-Cys | Cys | Glu | Phe | D-Cys | Cys | Asn | Pro | Ala | Cys | Thr | Gly | D-Cys | — |
| — | — | D-Cys | Cys | Glu | Phe | D-Cys | Cys | Asn | Pro | Ala | Cys | Thr | Gly | D-Cys | Lys |
| — | — | D-Cys | Cys | Glu | Phe | D-Cys | Cys | Asn | Pro | Ala | Cys | Thr | Gly | D-Cys | Tyr |
| — | — | D-Cys | Cys | Glu | Phe | D-Cys | Cys | Thr | Pro | Ala | Cys | Thr | Gly | Cys | — |
| — | — | D-Cys | Cys | Glu | Phe | D-Cys | Cys | Thr | Pro | Ala | Cys | Thr | Gly | Cys | Lys |
| — | — | D-Cys | Cys | Glu | Phe | D-Cys | Cys | Thr | Pro | Ala | Cys | Thr | Gly | Cys | Tyr |
| — | — | D-Cys | Cys | Glu | Phe | D-Cys | Cys | Thr | Pro | Ala | Cys | Thr | Gly | D-Cys | — |
| — | — | D-Cys | Cys | Glu | Phe | D-Cys | Cys | Thr | Pro | Ala | Cys | Thr | Gly | D-Cys | Lys |
| — | — | D-Cys | Cys | Glu | Phe | D-Cys | Cys | Thr | Pro | Ala | Cys | Thr | Gly | D-Cys | Tyr |
| — | — | D-Cys | Cys | Glu | Trp | Cys | Cys | Asn | Pro | Ala | Cys | Thr | Gly | Cys | — |
| — | — | D-Cys | Cys | Glu | Trp | Cys | Cys | Asn | Pro | Ala | Cys | Thr | Gly | Cys | Lys |
| — | — | D-Cys | Cys | Glu | Trp | Cys | Cys | Asn | Pro | Ala | Cys | Thr | Gly | Cys | Tyr |
| — | — | D-Cys | Cys | Glu | Trp | Cys | Cys | Asn | Pro | Ala | Cys | Thr | Gly | D-Cys | — |
| — | — | D-Cys | Cys | Glu | Trp | Cys | Cys | Asn | Pro | Ala | Cys | Thr | Gly | D-Cys | Lys |
| — | — | D-Cys | Cys | Glu | Trp | Cys | Cys | Asn | Pro | Ala | Cys | Thr | Gly | D-Cys | Tyr |
| — | — | D-Cys | Cys | Glu | Trp | Cys | Cys | Thr | Pro | Ala | Cys | Thr | Gly | Cys | — |
| — | — | D-Cys | Cys | Glu | Trp | Cys | Cys | Thr | Pro | Ala | Cys | Thr | Gly | Cys | Lys |
| — | — | D-Cys | Cys | Glu | Trp | Cys | Cys | Thr | Pro | Ala | Cys | Thr | Gly | Cys | Tyr |
| — | — | D-Cys | Cys | Glu | Trp | Cys | Cys | Thr | Pro | Ala | Cys | Thr | Gly | D-Cys | — |
| — | — | D-Cys | Cys | Glu | Trp | Cys | Cys | Thr | Pro | Ala | Cys | Thr | Gly | D-Cys | Lys |
| — | — | D-Cys | Cys | Glu | Trp | Cys | Cys | Thr | Pro | Ala | Cys | Thr | Gly | D-Cys | Tyr |
| — | — | D-Cys | Cys | Glu | Trp | D-Cys | Cys | Asn | Pro | Ala | Cys | Thr | Gly | Cys | — |
| — | — | D-Cys | Cys | Glu | Trp | D-Cys | Cys | Asn | Pro | Ala | Cys | Thr | Gly | Cys | Lys |
| — | — | D-Cys | Cys | Glu | Trp | D-Cys | Cys | Asn | Pro | Ala | Cys | Thr | Gly | Cys | Tyr |
| — | — | D-Cys | Cys | Glu | Trp | D-Cys | Cys | Asn | Pro | Ala | Cys | Thr | Gly | D-Cys | — |
| — | — | D-Cys | Cys | Glu | Trp | D-Cys | Cys | Asn | Pro | Ala | Cys | Thr | Gly | D-Cys | Lys |
| — | — | D-Cys | Cys | Glu | Trp | D-Cys | Cys | Asn | Pro | Ala | Cys | Thr | Gly | D-Cys | Tyr |
| — | — | D-Cys | Cys | Glu | Trp | D-Cys | Cys | Thr | Pro | Ala | Cys | Thr | Gly | Cys | — |
| — | — | D-Cys | Cys | Glu | Trp | D-Cys | Cys | Thr | Pro | Ala | Cys | Thr | Gly | Cys | Lys |
| — | — | D-Cys | Cys | Glu | Trp | D-Cys | Cys | Thr | Pro | Ala | Cys | Thr | Gly | Cys | Tyr |
| — | — | D-Cys | Cys | Glu | Trp | D-Cys | Cys | Thr | Pro | Ala | Cys | Thr | Gly | D-Cys | — |
| — | — | D-Cys | Cys | Glu | Trp | D-Cys | Cys | Thr | Pro | Ala | Cys | Thr | Gly | D-Cys | Lys |
| — | — | D-Cys | Cys | Glu | Trp | D-Cys | Cys | Thr | Pro | Ala | Cys | Thr | Gly | D-Cys | Tyr |
| — | Ala | Cys | Cys | Glu | Val | Cys | Cys | Asn | Pro | Ala | Cys | Thr | Gly | Cys | — |
| — | Ala | Cys | Cys | Glu | Val | Cys | Cys | Asn | Pro | Ala | Cys | Thr | Gly | Cys | Lys |
| — | Ala | Cys | Cys | Glu | Val | Cys | Cys | Asn | Pro | Ala | Cys | Thr | Gly | Cys | Tyr |
| — | Ala | Cys | Cys | Glu | Val | Cys | Cys | Asn | Pro | Ala | Cys | Thr | Gly | D-Cys | — |
| — | Ala | Cys | Cys | Glu | Val | Cys | Cys | Asn | Pro | Ala | Cys | Thr | Gly | D-Cys | Lys |
| — | Ala | Cys | Cys | Glu | Val | Cys | Cys | Asn | Pro | Ala | Cys | Thr | Gly | D-Cys | Tyr |
| — | Ala | Cys | Cys | Glu | Val | Cys | Cys | Thr | Pro | Ala | Cys | Thr | Gly | Cys | — |
| — | Ala | Cys | Cys | Glu | Val | Cys | Cys | Thr | Pro | Ala | Cys | Thr | Gly | Cys | Lys |
| — | Ala | Cys | Cys | Glu | Val | Cys | Cys | Thr | Pro | Ala | Cys | Thr | Gly | Cys | Tyr |
| — | Ala | Cys | Cys | Glu | Val | Cys | Cys | Thr | Pro | Ala | Cys | Thr | Gly | D-Cys | — |
| — | Ala | Cys | Cys | Glu | Val | Cys | Cys | Thr | Pro | Ala | Cys | Thr | Gly | D-Cys | Lys |
| — | Ala | Cys | Cys | Glu | Val | Cys | Cys | Thr | Pro | Ala | Cys | Thr | Gly | D-Cys | Tyr |
| — | Ala | Cys | Cys | Glu | Val | D-Cys | Cys | Asn | Pro | Ala | Cys | Thr | Gly | Cys | — |
| — | Ala | Cys | Cys | Glu | Val | D-Cys | Cys | Asn | Pro | Ala | Cys | Thr | Gly | Cys | Lys |
| — | Ala | Cys | Cys | Glu | Val | D-Cys | Cys | Asn | Pro | Ala | Cys | Thr | Gly | Cys | Tyr |

FIG. 3A-5

| | | | | | | | | | | | | | |
|---|---|---|---|---|---|---|---|---|---|---|---|---|---|
| — | Ala | Cys | Cys | Glu | Val | D-Cys | Cys | Asn | Pro | Ala | Cys | Thr | Gly | D-Cys — |
| — | Ala | Cys | Cys | Glu | Val | D-Cys | Cys | Asn | Pro | Ala | Cys | Thr | Gly | D-Cys Lys |
| — | Ala | Cys | Cys | Glu | Val | D-Cys | Cys | Asn | Pro | Ala | Cys | Thr | Gly | D-Cys Tyr |
| — | Ala | Cys | Cys | Glu | Val | D-Cys | Cys | Thr | Pro | Ala | Cys | Thr | Gly | Cys — |
| — | Ala | Cys | Cys | Glu | Val | D-Cys | Cys | Thr | Pro | Ala | Cys | Thr | Gly | Cys Lys |
| — | Ala | Cys | Cys | Glu | Val | D-Cys | Cys | Thr | Pro | Ala | Cys | Thr | Gly | Cys Tyr |
| — | Ala | Cys | Cys | Glu | Val | D-Cys | Cys | Thr | Pro | Ala | Cys | Thr | Gly | D-Cys — |
| — | Ala | Cys | Cys | Glu | Val | D-Cys | Cys | Thr | Pro | Ala | Cys | Thr | Gly | D-Cys Lys |
| — | Ala | Cys | Cys | Glu | Val | D-Cys | Cys | Thr | Pro | Ala | Cys | Thr | Gly | D-Cys Tyr |
| — | Ala | Cys | Cys | Glu | Ile | Cys | Cys | Asn | Pro | Ala | Cys | Thr | Gly | Cys — |
| — | Ala | Cys | Cys | Glu | Ile | Cys | Cys | Asn | Pro | Ala | Cys | Thr | Gly | Cys Lys |
| — | Ala | Cys | Cys | Glu | Ile | Cys | Cys | Asn | Pro | Ala | Cys | Thr | Gly | Cys Tyr |
| — | Ala | Cys | Cys | Glu | Ile | Cys | Cys | Asn | Pro | Ala | Cys | Thr | Gly | D-Cys — |
| — | Ala | Cys | Cys | Glu | Ile | Cys | Cys | Asn | Pro | Ala | Cys | Thr | Gly | D-Cys Lys |
| — | Ala | Cys | Cys | Glu | Ile | Cys | Cys | Asn | Pro | Ala | Cys | Thr | Gly | D-Cys Tyr |
| — | Ala | Cys | Cys | Glu | Ile | Cys | Cys | Thr | Pro | Ala | Cys | Thr | Gly | Cys — |
| — | Ala | Cys | Cys | Glu | Ile | Cys | Cys | Thr | Pro | Ala | Cys | Thr | Gly | Cys Lys |
| — | Ala | Cys | Cys | Glu | Ile | Cys | Cys | Thr | Pro | Ala | Cys | Thr | Gly | Cys Tyr |
| — | Ala | Cys | Cys | Glu | Ile | Cys | Cys | Thr | Pro | Ala | Cys | Thr | Gly | D-Cys — |
| — | Ala | Cys | Cys | Glu | Ile | Cys | Cys | Thr | Pro | Ala | Cys | Thr | Gly | D-Cys Lys |
| — | Ala | Cys | Cys | Glu | Ile | Cys | Cys | Thr | Pro | Ala | Cys | Thr | Gly | D-Cys Tyr |
| — | Ala | Cys | Cys | Glu | Ile | D-Cys | Cys | Asn | Pro | Ala | Cys | Thr | Gly | Cys — |
| — | Ala | Cys | Cys | Glu | Ile | D-Cys | Cys | Asn | Pro | Ala | Cys | Thr | Gly | Cys Lys |
| — | Ala | Cys | Cys | Glu | Ile | D-Cys | Cys | Asn | Pro | Ala | Cys | Thr | Gly | Cys Tyr |
| — | Ala | Cys | Cys | Glu | Ile | D-Cys | Cys | Asn | Pro | Ala | Cys | Thr | Gly | D-Cys — |
| — | Ala | Cys | Cys | Glu | Ile | D-Cys | Cys | Asn | Pro | Ala | Cys | Thr | Gly | D-Cys Lys |
| — | Ala | Cys | Cys | Glu | Ile | D-Cys | Cys | Asn | Pro | Ala | Cys | Thr | Gly | D-Cys Tyr |
| — | Ala | Cys | Cys | Glu | Ile | D-Cys | Cys | Thr | Pro | Ala | Cys | Thr | Gly | Cys — |
| — | Ala | Cys | Cys | Glu | Ile | D-Cys | Cys | Thr | Pro | Ala | Cys | Thr | Gly | Cys Lys |
| — | Ala | Cys | Cys | Glu | Ile | D-Cys | Cys | Thr | Pro | Ala | Cys | Thr | Gly | Cys Tyr |
| — | Ala | Cys | Cys | Glu | Ile | D-Cys | Cys | Thr | Pro | Ala | Cys | Thr | Gly | D-Cys — |
| — | Ala | Cys | Cys | Glu | Ile | D-Cys | Cys | Thr | Pro | Ala | Cys | Thr | Gly | D-Cys Lys |
| — | Ala | Cys | Cys | Glu | Ile | D-Cys | Cys | Thr | Pro | Ala | Cys | Thr | Gly | D-Cys Tyr |
| — | Ala | Cys | Cys | Glu | Leu | Cys | Cys | Asn | Pro | Ala | Cys | Thr | Gly | Cys — |
| — | Ala | Cys | Cys | Glu | Leu | Cys | Cys | Asn | Pro | Ala | Cys | Thr | Gly | Cys Lys |
| — | Ala | Cys | Cys | Glu | Leu | Cys | Cys | Asn | Pro | Ala | Cys | Thr | Gly | Cys Tyr |
| — | Ala | Cys | Cys | Glu | Leu | Cys | Cys | Asn | Pro | Ala | Cys | Thr | Gly | D-Cys — |
| — | Ala | Cys | Cys | Glu | Leu | Cys | Cys | Asn | Pro | Ala | Cys | Thr | Gly | D-Cys Lys |
| — | Ala | Cys | Cys | Glu | Leu | Cys | Cys | Asn | Pro | Ala | Cys | Thr | Gly | D-Cys Tyr |
| — | Ala | Cys | Cys | Glu | Leu | Cys | Cys | Thr | Pro | Ala | Cys | Thr | Gly | Cys — |
| — | Ala | Cys | Cys | Glu | Leu | Cys | Cys | Thr | Pro | Ala | Cys | Thr | Gly | Cys Lys |
| — | Ala | Cys | Cys | Glu | Leu | Cys | Cys | Thr | Pro | Ala | Cys | Thr | Gly | Cys Tyr |
| — | Ala | Cys | Cys | Glu | Leu | Cys | Cys | Thr | Pro | Ala | Cys | Thr | Gly | D-Cys — |
| — | Ala | Cys | Cys | Glu | Leu | Cys | Cys | Thr | Pro | Ala | Cys | Thr | Gly | D-Cys Lys |
| — | Ala | Cys | Cys | Glu | Leu | Cys | Cys | Thr | Pro | Ala | Cys | Thr | Gly | D-Cys Tyr |
| — | Ala | Cys | Cys | Glu | Leu | D-Cys | Cys | Asn | Pro | Ala | Cys | Thr | Gly | Cys — |
| — | Ala | Cys | Cys | Glu | Leu | D-Cys | Cys | Asn | Pro | Ala | Cys | Thr | Gly | Cys Lys |
| — | Ala | Cys | Cys | Glu | Leu | D-Cys | Cys | Asn | Pro | Ala | Cys | Thr | Gly | Cys Tyr |
| — | Ala | Cys | Cys | Glu | Leu | D-Cys | Cys | Asn | Pro | Ala | Cys | Thr | Gly | D-Cys — |
| — | Ala | Cys | Cys | Glu | Leu | D-Cys | Cys | Asn | Pro | Ala | Cys | Thr | Gly | D-Cys Lys |
| — | Ala | Cys | Cys | Glu | Leu | D-Cys | Cys | Asn | Pro | Ala | Cys | Thr | Gly | D-Cys Tyr |
| — | Ala | Cys | Cys | Glu | Leu | D-Cys | Cys | Thr | Pro | Ala | Cys | Thr | Gly | Cys — |
| — | Ala | Cys | Cys | Glu | Leu | D-Cys | Cys | Thr | Pro | Ala | Cys | Thr | Gly | Cys Lys |
| — | Ala | Cys | Cys | Glu | Leu | D-Cys | Cys | Thr | Pro | Ala | Cys | Thr | Gly | Cys Tyr |
| — | Ala | Cys | Cys | Glu | Leu | D-Cys | Cys | Thr | Pro | Ala | Cys | Thr | Gly | D-Cys — |
| — | Ala | Cys | Cys | Glu | Leu | D-Cys | Cys | Thr | Pro | Ala | Cys | Thr | Gly | D-Cys Lys |
| — | Ala | Cys | Cys | Glu | Leu | D-Cys | Cys | Thr | Pro | Ala | Cys | Thr | Gly | D-Cys Tyr |
| — | Ala | Cys | Cys | Glu | Tyr | Cys | Cys | Asn | Pro | Ala | Cys | Thr | Gly | Cys — |
| — | Ala | Cys | Cys | Glu | Tyr | Cys | Cys | Asn | Pro | Ala | Cys | Thr | Gly | Cys Lys |
| — | Ala | Cys | Cys | Glu | Tyr | Cys | Cys | Asn | Pro | Ala | Cys | Thr | Gly | Cys Tyr |

FIG. 3A-6

| | | | | | | | | | | | | | |
|---|---|---|---|---|---|---|---|---|---|---|---|---|---|
| — | Ala | Cys | Cys | Glu | Tyr | Cys | Cys | Asn | Pro | Ala | Cys | Thr | Gly | D-Cys — |
| — | Ala | Cys | Cys | Glu | Tyr | Cys | Cys | Asn | Pro | Ala | Cys | Thr | Gly | D-Cys Lys |
| — | Ala | Cys | Cys | Glu | Tyr | Cys | Cys | Asn | Pro | Ala | Cys | Thr | Gly | D-Cys Tyr |
| — | Ala | Cys | Cys | Glu | Tyr | Cys | Cys | Thr | Pro | Ala | Cys | Thr | Gly | Cys — |
| — | Ala | Cys | Cys | Glu | Tyr | Cys | Cys | Thr | Pro | Ala | Cys | Thr | Gly | Cys Lys |
| — | Ala | Cys | Cys | Glu | Tyr | Cys | Cys | Thr | Pro | Ala | Cys | Thr | Gly | Cys Tyr |
| — | Ala | Cys | Cys | Glu | Tyr | Cys | Cys | Thr | Pro | Ala | Cys | Thr | Gly | D-Cys — |
| — | Ala | Cys | Cys | Glu | Tyr | Cys | Cys | Thr | Pro | Ala | Cys | Thr | Gly | D-Cys Lys |
| — | Ala | Cys | Cys | Glu | Tyr | Cys | Cys | Thr | Pro | Ala | Cys | Thr | Gly | D-Cys Tyr |
| — | Ala | Cys | Cys | Glu | Tyr | D-Cys | Cys | Asn | Pro | Ala | Cys | Thr | Gly | Cys — |
| — | Ala | Cys | Cys | Glu | Tyr | D-Cys | Cys | Asn | Pro | Ala | Cys | Thr | Gly | Cys Lys |
| — | Ala | Cys | Cys | Glu | Tyr | D-Cys | Cys | Asn | Pro | Ala | Cys | Thr | Gly | Cys Tyr |
| — | Ala | Cys | Cys | Glu | Tyr | D-Cys | Cys | Asn | Pro | Ala | Cys | Thr | Gly | D-Cys — |
| — | Ala | Cys | Cys | Glu | Tyr | D-Cys | Cys | Asn | Pro | Ala | Cys | Thr | Gly | D-Cys Lys |
| — | Ala | Cys | Cys | Glu | Tyr | D-Cys | Cys | Asn | Pro | Ala | Cys | Thr | Gly | D-Cys Tyr |
| — | Ala | Cys | Cys | Glu | Tyr | D-Cys | Cys | Thr | Pro | Ala | Cys | Thr | Gly | Cys — |
| — | Ala | Cys | Cys | Glu | Tyr | D-Cys | Cys | Thr | Pro | Ala | Cys | Thr | Gly | Cys Lys |
| — | Ala | Cys | Cys | Glu | Tyr | D-Cys | Cys | Thr | Pro | Ala | Cys | Thr | Gly | Cys Tyr |
| — | Ala | Cys | Cys | Glu | Tyr | D-Cys | Cys | Thr | Pro | Ala | Cys | Thr | Gly | D-Cys — |
| — | Ala | Cys | Cys | Glu | Tyr | D-Cys | Cys | Thr | Pro | Ala | Cys | Thr | Gly | D-Cys Lys |
| — | Ala | Cys | Cys | Glu | Tyr | D-Cys | Cys | Thr | Pro | Ala | Cys | Thr | Gly | D-Cys Tyr |
| — | Ala | Cys | Cys | Glu | Phe | Cys | Cys | Asn | Pro | Ala | Cys | Thr | Gly | Cys — |
| — | Ala | Cys | Cys | Glu | Phe | Cys | Cys | Asn | Pro | Ala | Cys | Thr | Gly | Cys Lys |
| — | Ala | Cys | Cys | Glu | Phe | Cys | Cys | Asn | Pro | Ala | Cys | Thr | Gly | Cys Tyr |
| — | Ala | Cys | Cys | Glu | Phe | Cys | Cys | Asn | Pro | Ala | Cys | Thr | Gly | D-Cys — |
| — | Ala | Cys | Cys | Glu | Phe | Cys | Cys | Asn | Pro | Ala | Cys | Thr | Gly | D-Cys Lys |
| — | Ala | Cys | Cys | Glu | Phe | Cys | Cys | Asn | Pro | Ala | Cys | Thr | Gly | D-Cys Tyr |
| — | Ala | Cys | Cys | Glu | Phe | Cys | Cys | Thr | Pro | Ala | Cys | Thr | Gly | Cys — |
| — | Ala | Cys | Cys | Glu | Phe | Cys | Cys | Thr | Pro | Ala | Cys | Thr | Gly | Cys Lys |
| — | Ala | Cys | Cys | Glu | Phe | Cys | Cys | Thr | Pro | Ala | Cys | Thr | Gly | Cys Tyr |
| — | Ala | Cys | Cys | Glu | Phe | Cys | Cys | Thr | Pro | Ala | Cys | Thr | Gly | D-Cys — |
| — | Ala | Cys | Cys | Glu | Phe | Cys | Cys | Thr | Pro | Ala | Cys | Thr | Gly | D-Cys Lys |
| — | Ala | Cys | Cys | Glu | Phe | Cys | Cys | Thr | Pro | Ala | Cys | Thr | Gly | D-Cys Tyr |
| — | Ala | Cys | Cys | Glu | Phe | D-Cys | Cys | Asn | Pro | Ala | Cys | Thr | Gly | Cys — |
| — | Ala | Cys | Cys | Glu | Phe | D-Cys | Cys | Asn | Pro | Ala | Cys | Thr | Gly | Cys Lys |
| — | Ala | Cys | Cys | Glu | Phe | D-Cys | Cys | Asn | Pro | Ala | Cys | Thr | Gly | Cys Tyr |
| — | Ala | Cys | Cys | Glu | Phe | D-Cys | Cys | Asn | Pro | Ala | Cys | Thr | Gly | D-Cys — |
| — | Ala | Cys | Cys | Glu | Phe | D-Cys | Cys | Asn | Pro | Ala | Cys | Thr | Gly | D-Cys Lys |
| — | Ala | Cys | Cys | Glu | Phe | D-Cys | Cys | Asn | Pro | Ala | Cys | Thr | Gly | D-Cys Tyr |
| — | Ala | Cys | Cys | Glu | Phe | D-Cys | Cys | Thr | Pro | Ala | Cys | Thr | Gly | Cys — |
| — | Ala | Cys | Cys | Glu | Phe | D-Cys | Cys | Thr | Pro | Ala | Cys | Thr | Gly | Cys Lys |
| — | Ala | Cys | Cys | Glu | Phe | D-Cys | Cys | Thr | Pro | Ala | Cys | Thr | Gly | Cys Tyr |
| — | Ala | Cys | Cys | Glu | Phe | D-Cys | Cys | Thr | Pro | Ala | Cys | Thr | Gly | D-Cys — |
| — | Ala | Cys | Cys | Glu | Phe | D-Cys | Cys | Thr | Pro | Ala | Cys | Thr | Gly | D-Cys Lys |
| — | Ala | Cys | Cys | Glu | Phe | D-Cys | Cys | Thr | Pro | Ala | Cys | Thr | Gly | D-Cys Tyr |
| — | Ala | Cys | Cys | Glu | Trp | Cys | Cys | Asn | Pro | Ala | Cys | Thr | Gly | Cys — |
| — | Ala | Cys | Cys | Glu | Trp | Cys | Cys | Asn | Pro | Ala | Cys | Thr | Gly | Cys Lys |
| — | Ala | Cys | Cys | Glu | Trp | Cys | Cys | Asn | Pro | Ala | Cys | Thr | Gly | Cys Tyr |
| — | Ala | Cys | Cys | Glu | Trp | Cys | Cys | Asn | Pro | Ala | Cys | Thr | Gly | D-Cys — |
| — | Ala | Cys | Cys | Glu | Trp | Cys | Cys | Asn | Pro | Ala | Cys | Thr | Gly | D-Cys Lys |
| — | Ala | Cys | Cys | Glu | Trp | Cys | Cys | Asn | Pro | Ala | Cys | Thr | Gly | D-Cys Tyr |
| — | Ala | Cys | Cys | Glu | Trp | Cys | Cys | Thr | Pro | Ala | Cys | Thr | Gly | Cys — |
| — | Ala | Cys | Cys | Glu | Trp | Cys | Cys | Thr | Pro | Ala | Cys | Thr | Gly | Cys Lys |
| — | Ala | Cys | Cys | Glu | Trp | Cys | Cys | Thr | Pro | Ala | Cys | Thr | Gly | Cys Tyr |
| — | Ala | Cys | Cys | Glu | Trp | Cys | Cys | Thr | Pro | Ala | Cys | Thr | Gly | D-Cys — |
| — | Ala | Cys | Cys | Glu | Trp | Cys | Cys | Thr | Pro | Ala | Cys | Thr | Gly | D-Cys Lys |
| — | Ala | Cys | Cys | Glu | Trp | Cys | Cys | Thr | Pro | Ala | Cys | Thr | Gly | D-Cys Tyr |
| — | Ala | Cys | Cys | Glu | Trp | D-Cys | Cys | Asn | Pro | Ala | Cys | Thr | Gly | Cys — |
| — | Ala | Cys | Cys | Glu | Trp | D-Cys | Cys | Asn | Pro | Ala | Cys | Thr | Gly | Cys Lys |
| — | Ala | Cys | Cys | Glu | Trp | D-Cys | Cys | Asn | Pro | Ala | Cys | Thr | Gly | Cys Tyr |

FIG. 3A-7

| | | | | | | | | | | | | | | |
|---|---|---|---|---|---|---|---|---|---|---|---|---|---|---|
| — | Ala | Cys | Cys | Glu | Trp | D-Cys | Cys | Asn | Pro | Ala | Cys | Thr | Gly | D-Cys | — |
| — | Ala | Cys | Cys | Glu | Trp | D-Cys | Cys | Asn | Pro | Ala | Cys | Thr | Gly | D-Cys | Lys |
| — | Ala | Cys | Cys | Glu | Trp | D-Cys | Cys | Asn | Pro | Ala | Cys | Thr | Gly | D-Cys | Tyr |
| — | Ala | Cys | Cys | Glu | Trp | D-Cys | Cys | Thr | Pro | Ala | Cys | Thr | Gly | Cys | — |
| — | Ala | Cys | Cys | Glu | Trp | D-Cys | Cys | Thr | Pro | Ala | Cys | Thr | Gly | Cys | Lys |
| — | Ala | Cys | Cys | Glu | Trp | D-Cys | Cys | Thr | Pro | Ala | Cys | Thr | Gly | Cys | Tyr |
| — | Ala | Cys | Cys | Glu | Trp | D-Cys | Cys | Thr | Pro | Ala | Cys | Thr | Gly | D-Cys | — |
| — | Ala | Cys | Cys | Glu | Trp | D-Cys | Cys | Thr | Pro | Ala | Cys | Thr | Gly | D-Cys | Lys |
| — | Ala | Cys | Cys | Glu | Trp | D-Cys | Cys | Thr | Pro | Ala | Cys | Thr | Gly | D-Cys | Tyr |
| — | Ala | D-Cys | Cys | Glu | Val | Cys | Cys | Asn | Pro | Ala | Cys | Thr | Gly | Cys | — |
| — | Ala | D-Cys | Cys | Glu | Val | Cys | Cys | Asn | Pro | Ala | Cys | Thr | Gly | Cys | Lys |
| — | Ala | D-Cys | Cys | Glu | Val | Cys | Cys | Asn | Pro | Ala | Cys | Thr | Gly | Cys | Tyr |
| — | Ala | D-Cys | Cys | Glu | Val | Cys | Cys | Asn | Pro | Ala | Cys | Thr | Gly | D-Cys | — |
| — | Ala | D-Cys | Cys | Glu | Val | Cys | Cys | Asn | Pro | Ala | Cys | Thr | Gly | D-Cys | Lys |
| — | Ala | D-Cys | Cys | Glu | Val | Cys | Cys | Asn | Pro | Ala | Cys | Thr | Gly | D-Cys | Tyr |
| — | Ala | D-Cys | Cys | Glu | Val | Cys | Cys | Thr | Pro | Ala | Cys | Thr | Gly | Cys | — |
| — | Ala | D-Cys | Cys | Glu | Val | Cys | Cys | Thr | Pro | Ala | Cys | Thr | Gly | Cys | Lys |
| — | Ala | D-Cys | Cys | Glu | Val | Cys | Cys | Thr | Pro | Ala | Cys | Thr | Gly | Cys | Tyr |
| — | Ala | D-Cys | Cys | Glu | Val | Cys | Cys | Thr | Pro | Ala | Cys | Thr | Gly | D-Cys | — |
| — | Ala | D-Cys | Cys | Glu | Val | Cys | Cys | Thr | Pro | Ala | Cys | Thr | Gly | D-Cys | Lys |
| — | Ala | D-Cys | Cys | Glu | Val | Cys | Cys | Thr | Pro | Ala | Cys | Thr | Gly | D-Cys | Tyr |
| — | Ala | D-Cys | Cys | Glu | Val | D-Cys | Cys | Asn | Pro | Ala | Cys | Thr | Gly | Cys | — |
| — | Ala | D-Cys | Cys | Glu | Val | D-Cys | Cys | Asn | Pro | Ala | Cys | Thr | Gly | Cys | Lys |
| — | Ala | D-Cys | Cys | Glu | Val | D-Cys | Cys | Asn | Pro | Ala | Cys | Thr | Gly | Cys | Tyr |
| — | Ala | D-Cys | Cys | Glu | Val | D-Cys | Cys | Asn | Pro | Ala | Cys | Thr | Gly | D-Cys | — |
| — | Ala | D-Cys | Cys | Glu | Val | D-Cys | Cys | Asn | Pro | Ala | Cys | Thr | Gly | D-Cys | Lys |
| — | Ala | D-Cys | Cys | Glu | Val | D-Cys | Cys | Asn | Pro | Ala | Cys | Thr | Gly | D-Cys | Tyr |
| — | Ala | D-Cys | Cys | Glu | Val | D-Cys | Cys | Thr | Pro | Ala | Cys | Thr | Gly | Cys | — |
| — | Ala | D-Cys | Cys | Glu | Val | D-Cys | Cys | Thr | Pro | Ala | Cys | Thr | Gly | Cys | Lys |
| — | Ala | D-Cys | Cys | Glu | Val | D-Cys | Cys | Thr | Pro | Ala | Cys | Thr | Gly | Cys | Tyr |
| — | Ala | D-Cys | Cys | Glu | Val | D-Cys | Cys | Thr | Pro | Ala | Cys | Thr | Gly | D-Cys | — |
| — | Ala | D-Cys | Cys | Glu | Val | D-Cys | Cys | Thr | Pro | Ala | Cys | Thr | Gly | D-Cys | Lys |
| — | Ala | D-Cys | Cys | Glu | Val | D-Cys | Cys | Thr | Pro | Ala | Cys | Thr | Gly | D-Cys | Tyr |
| — | Ala | D-Cys | Cys | Glu | Ile | Cys | Cys | Asn | Pro | Ala | Cys | Thr | Gly | Cys | — |
| — | Ala | D-Cys | Cys | Glu | Ile | Cys | Cys | Asn | Pro | Ala | Cys | Thr | Gly | Cys | Lys |
| — | Ala | D-Cys | Cys | Glu | Ile | Cys | Cys | Asn | Pro | Ala | Cys | Thr | Gly | Cys | Tyr |
| — | Ala | D-Cys | Cys | Glu | Ile | Cys | Cys | Asn | Pro | Ala | Cys | Thr | Gly | D-Cys | — |
| — | Ala | D-Cys | Cys | Glu | Ile | Cys | Cys | Asn | Pro | Ala | Cys | Thr | Gly | D-Cys | Lys |
| — | Ala | D-Cys | Cys | Glu | Ile | Cys | Cys | Asn | Pro | Ala | Cys | Thr | Gly | D-Cys | Tyr |
| — | Ala | D-Cys | Cys | Glu | Ile | Cys | Cys | Thr | Pro | Ala | Cys | Thr | Gly | Cys | — |
| — | Ala | D-Cys | Cys | Glu | Ile | Cys | Cys | Thr | Pro | Ala | Cys | Thr | Gly | Cys | Lys |
| — | Ala | D-Cys | Cys | Glu | Ile | Cys | Cys | Thr | Pro | Ala | Cys | Thr | Gly | Cys | Tyr |
| — | Ala | D-Cys | Cys | Glu | Ile | Cys | Cys | Thr | Pro | Ala | Cys | Thr | Gly | D-Cys | — |
| — | Ala | D-Cys | Cys | Glu | Ile | Cys | Cys | Thr | Pro | Ala | Cys | Thr | Gly | D-Cys | Lys |
| — | Ala | D-Cys | Cys | Glu | Ile | Cys | Cys | Thr | Pro | Ala | Cys | Thr | Gly | D-Cys | Tyr |
| — | Ala | D-Cys | Cys | Glu | Ile | D-Cys | Cys | Asn | Pro | Ala | Cys | Thr | Gly | Cys | — |
| — | Ala | D-Cys | Cys | Glu | Ile | D-Cys | Cys | Asn | Pro | Ala | Cys | Thr | Gly | Cys | Lys |
| — | Ala | D-Cys | Cys | Glu | Ile | D-Cys | Cys | Asn | Pro | Ala | Cys | Thr | Gly | Cys | Tyr |
| — | Ala | D-Cys | Cys | Glu | Ile | D-Cys | Cys | Asn | Pro | Ala | Cys | Thr | Gly | D-Cys | — |
| — | Ala | D-Cys | Cys | Glu | Ile | D-Cys | Cys | Asn | Pro | Ala | Cys | Thr | Gly | D-Cys | Lys |
| — | Ala | D-Cys | Cys | Glu | Ile | D-Cys | Cys | Asn | Pro | Ala | Cys | Thr | Gly | D-Cys | Tyr |
| — | Ala | D-Cys | Cys | Glu | Ile | D-Cys | Cys | Thr | Pro | Ala | Cys | Thr | Gly | Cys | — |
| — | Ala | D-Cys | Cys | Glu | Ile | D-Cys | Cys | Thr | Pro | Ala | Cys | Thr | Gly | Cys | Lys |
| — | Ala | D-Cys | Cys | Glu | Ile | D-Cys | Cys | Thr | Pro | Ala | Cys | Thr | Gly | Cys | Tyr |
| — | Ala | D-Cys | Cys | Glu | Ile | D-Cys | Cys | Thr | Pro | Ala | Cys | Thr | Gly | D-Cys | — |
| — | Ala | D-Cys | Cys | Glu | Ile | D-Cys | Cys | Thr | Pro | Ala | Cys | Thr | Gly | D-Cys | Lys |
| — | Ala | D-Cys | Cys | Glu | Ile | D-Cys | Cys | Thr | Pro | Ala | Cys | Thr | Gly | D-Cys | Tyr |
| — | Ala | D-Cys | Cys | Glu | Leu | Cys | Cys | Asn | Pro | Ala | Cys | Thr | Gly | Cys | — |
| — | Ala | D-Cys | Cys | Glu | Leu | Cys | Cys | Asn | Pro | Ala | Cys | Thr | Gly | Cys | Lys |
| — | Ala | D-Cys | Cys | Glu | Leu | Cys | Cys | Asn | Pro | Ala | Cys | Thr | Gly | Cys | Tyr |

FIG. 3A-8

| | Ala | D-Cys | Cys | Glu | Leu | Cys | Cys | Asn | Pro | Ala | Cys | Thr | Gly | D-Cys | — |
|---|---|---|---|---|---|---|---|---|---|---|---|---|---|---|---|
| — | Ala | D-Cys | Cys | Glu | Leu | Cys | Cys | Asn | Pro | Ala | Cys | Thr | Gly | D-Cys | Lys |
| — | Ala | D-Cys | Cys | Glu | Leu | Cys | Cys | Asn | Pro | Ala | Cys | Thr | Gly | D-Cys | Tyr |
| — | Ala | D-Cys | Cys | Glu | Leu | Cys | Cys | Thr | Pro | Ala | Cys | Thr | Gly | Cys | — |
| — | Ala | D-Cys | Cys | Glu | Leu | Cys | Cys | Thr | Pro | Ala | Cys | Thr | Gly | Cys | Lys |
| — | Ala | D-Cys | Cys | Glu | Leu | Cys | Cys | Thr | Pro | Ala | Cys | Thr | Gly | Cys | Tyr |
| — | Ala | D-Cys | Cys | Glu | Leu | Cys | Cys | Thr | Pro | Ala | Cys | Thr | Gly | D-Cys | — |
| — | Ala | D-Cys | Cys | Glu | Leu | Cys | Cys | Thr | Pro | Ala | Cys | Thr | Gly | D-Cys | Lys |
| — | Ala | D-Cys | Cys | Glu | Leu | Cys | Cys | Thr | Pro | Ala | Cys | Thr | Gly | D-Cys | Tyr |
| — | Ala | D-Cys | Cys | Glu | Leu | D-Cys | Cys | Asn | Pro | Ala | Cys | Thr | Gly | Cys | — |
| — | Ala | D-Cys | Cys | Glu | Leu | D-Cys | Cys | Asn | Pro | Ala | Cys | Thr | Gly | Cys | Lys |
| — | Ala | D-Cys | Cys | Glu | Leu | D-Cys | Cys | Asn | Pro | Ala | Cys | Thr | Gly | Cys | Tyr |
| — | Ala | D-Cys | Cys | Glu | Leu | D-Cys | Cys | Asn | Pro | Ala | Cys | Thr | Gly | D-Cys | — |
| — | Ala | D-Cys | Cys | Glu | Leu | D-Cys | Cys | Asn | Pro | Ala | Cys | Thr | Gly | D-Cys | Lys |
| — | Ala | D-Cys | Cys | Glu | Leu | D-Cys | Cys | Asn | Pro | Ala | Cys | Thr | Gly | D-Cys | Tyr |
| — | Ala | D-Cys | Cys | Glu | Leu | D-Cys | Cys | Thr | Pro | Ala | Cys | Thr | Gly | Cys | — |
| — | Ala | D-Cys | Cys | Glu | Leu | D-Cys | Cys | Thr | Pro | Ala | Cys | Thr | Gly | Cys | Lys |
| — | Ala | D-Cys | Cys | Glu | Leu | D-Cys | Cys | Thr | Pro | Ala | Cys | Thr | Gly | Cys | Tyr |
| — | Ala | D-Cys | Cys | Glu | Leu | D-Cys | Cys | Thr | Pro | Ala | Cys | Thr | Gly | D-Cys | — |
| — | Ala | D-Cys | Cys | Glu | Leu | D-Cys | Cys | Thr | Pro | Ala | Cys | Thr | Gly | D-Cys | Lys |
| — | Ala | D-Cys | Cys | Glu | Leu | D-Cys | Cys | Thr | Pro | Ala | Cys | Thr | Gly | D-Cys | Tyr |
| — | Ala | D-Cys | Cys | Glu | Tyr | Cys | Cys | Asn | Pro | Ala | Cys | Thr | Gly | Cys | — |
| — | Ala | D-Cys | Cys | Glu | Tyr | Cys | Cys | Asn | Pro | Ala | Cys | Thr | Gly | Cys | Lys |
| — | Ala | D-Cys | Cys | Glu | Tyr | Cys | Cys | Asn | Pro | Ala | Cys | Thr | Gly | Cys | Tyr |
| — | Ala | D-Cys | Cys | Glu | Tyr | Cys | Cys | Asn | Pro | Ala | Cys | Thr | Gly | D-Cys | — |
| — | Ala | D-Cys | Cys | Glu | Tyr | Cys | Cys | Asn | Pro | Ala | Cys | Thr | Gly | D-Cys | Lys |
| — | Ala | D-Cys | Cys | Glu | Tyr | Cys | Cys | Asn | Pro | Ala | Cys | Thr | Gly | D-Cys | Tyr |
| — | Ala | D-Cys | Cys | Glu | Tyr | Cys | Cys | Thr | Pro | Ala | Cys | Thr | Gly | Cys | — |
| — | Ala | D-Cys | Cys | Glu | Tyr | Cys | Cys | Thr | Pro | Ala | Cys | Thr | Gly | Cys | Lys |
| — | Ala | D-Cys | Cys | Glu | Tyr | Cys | Cys | Thr | Pro | Ala | Cys | Thr | Gly | Cys | Tyr |
| — | Ala | D-Cys | Cys | Glu | Tyr | Cys | Cys | Thr | Pro | Ala | Cys | Thr | Gly | D-Cys | — |
| — | Ala | D-Cys | Cys | Glu | Tyr | Cys | Cys | Thr | Pro | Ala | Cys | Thr | Gly | D-Cys | Lys |
| — | Ala | D-Cys | Cys | Glu | Tyr | Cys | Cys | Thr | Pro | Ala | Cys | Thr | Gly | D-Cys | Tyr |
| — | Ala | D-Cys | Cys | Glu | Tyr | D-Cys | Cys | Asn | Pro | Ala | Cys | Thr | Gly | Cys | — |
| — | Ala | D-Cys | Cys | Glu | Tyr | D-Cys | Cys | Asn | Pro | Ala | Cys | Thr | Gly | Cys | Lys |
| — | Ala | D-Cys | Cys | Glu | Tyr | D-Cys | Cys | Asn | Pro | Ala | Cys | Thr | Gly | Cys | Tyr |
| — | Ala | D-Cys | Cys | Glu | Tyr | D-Cys | Cys | Asn | Pro | Ala | Cys | Thr | Gly | D-Cys | — |
| — | Ala | D-Cys | Cys | Glu | Tyr | D-Cys | Cys | Asn | Pro | Ala | Cys | Thr | Gly | D-Cys | Lys |
| — | Ala | D-Cys | Cys | Glu | Tyr | D-Cys | Cys | Asn | Pro | Ala | Cys | Thr | Gly | D-Cys | Tyr |
| — | Ala | D-Cys | Cys | Glu | Tyr | D-Cys | Cys | Thr | Pro | Ala | Cys | Thr | Gly | Cys | — |
| — | Ala | D-Cys | Cys | Glu | Tyr | D-Cys | Cys | Thr | Pro | Ala | Cys | Thr | Gly | Cys | Lys |
| — | Ala | D-Cys | Cys | Glu | Tyr | D-Cys | Cys | Thr | Pro | Ala | Cys | Thr | Gly | Cys | Tyr |
| — | Ala | D-Cys | Cys | Glu | Tyr | D-Cys | Cys | Thr | Pro | Ala | Cys | Thr | Gly | D-Cys | — |
| — | Ala | D-Cys | Cys | Glu | Tyr | D-Cys | Cys | Thr | Pro | Ala | Cys | Thr | Gly | D-Cys | Lys |
| — | Ala | D-Cys | Cys | Glu | Tyr | D-Cys | Cys | Thr | Pro | Ala | Cys | Thr | Gly | D-Cys | Tyr |
| — | Ala | D-Cys | Cys | Glu | Phe | Cys | Cys | Asn | Pro | Ala | Cys | Thr | Gly | Cys | — |
| — | Ala | D-Cys | Cys | Glu | Phe | Cys | Cys | Asn | Pro | Ala | Cys | Thr | Gly | Cys | Lys |
| — | Ala | D-Cys | Cys | Glu | Phe | Cys | Cys | Asn | Pro | Ala | Cys | Thr | Gly | Cys | Tyr |
| — | Ala | D-Cys | Cys | Glu | Phe | Cys | Cys | Asn | Pro | Ala | Cys | Thr | Gly | D-Cys | — |
| — | Ala | D-Cys | Cys | Glu | Phe | Cys | Cys | Asn | Pro | Ala | Cys | Thr | Gly | D-Cys | Lys |
| — | Ala | D-Cys | Cys | Glu | Phe | Cys | Cys | Asn | Pro | Ala | Cys | Thr | Gly | D-Cys | Tyr |
| — | Ala | D-Cys | Cys | Glu | Phe | Cys | Cys | Thr | Pro | Ala | Cys | Thr | Gly | Cys | — |
| — | Ala | D-Cys | Cys | Glu | Phe | Cys | Cys | Thr | Pro | Ala | Cys | Thr | Gly | Cys | Lys |
| — | Ala | D-Cys | Cys | Glu | Phe | Cys | Cys | Thr | Pro | Ala | Cys | Thr | Gly | Cys | Tyr |
| — | Ala | D-Cys | Cys | Glu | Phe | Cys | Cys | Thr | Pro | Ala | Cys | Thr | Gly | D-Cys | — |
| — | Ala | D-Cys | Cys | Glu | Phe | Cys | Cys | Thr | Pro | Ala | Cys | Thr | Gly | D-Cys | Lys |
| — | Ala | D-Cys | Cys | Glu | Phe | Cys | Cys | Thr. | Pro | Ala | Cys | Thr | Gly | D-Cys | Tyr |
| — | Ala | D-Cys | Cys | Glu | Phe | D-Cys | Cys | Asn | Pro | Ala | Cys | Thr | Gly | Cys | — |
| — | Ala | D-Cys | Cys | Glu | Phe | D-Cys | Cys | Asn | Pro | Ala | Cys | Thr | Gly | Cys | Lys |
| — | Ala | D-Cys | Cys | Glu | Phe | D-Cys | Cys | Asn | Pro | Ala | Cys | Thr | Gly | Cys | Tyr |

FIG. 3A-9

| | | | | | | | | | | | | | |
|---|---|---|---|---|---|---|---|---|---|---|---|---|---|
| — | Ala | D-Cys | Cys | Glu | Phe | D-Cys | Cys | Asn | Pro | Ala | Cys | Thr | Gly | D-Cys | — |
| — | Ala | D-Cys | Cys | Glu | Phe | D-Cys | Cys | Asn | Pro | Ala | Cys | Thr | Gly | D-Cys | Lys |
| — | Ala | D-Cys | Cys | Glu | Phe | D-Cys | Cys | Asn | Pro | Ala | Cys | Thr | Gly | D-Cys | Tyr |
| — | Ala | D-Cys | Cys | Glu | Phe | D-Cys | Cys | Thr | Pro | Ala | Cys | Thr | Gly | Cys | — |
| — | Ala | D-Cys | Cys | Glu | Phe | D-Cys | Cys | Thr | Pro | Ala | Cys | Thr | Gly | Cys | Lys |
| — | Ala | D-Cys | Cys | Glu | Phe | D-Cys | Cys | Thr | Pro | Ala | Cys | Thr | Gly | Cys | Tyr |
| — | Ala | D-Cys | Cys | Glu | Phe | D-Cys | Cys | Thr | Pro | Ala | Cys | Thr | Gly | D-Cys | — |
| — | Ala | D-Cys | Cys | Glu | Phe | D-Cys | Cys | Thr | Pro | Ala | Cys | Thr | Gly | D-Cys | Lys |
| — | Ala | D-Cys | Cys | Glu | Phe | D-Cys | Cys | Thr | Pro | Ala | Cys | Thr | Gly | D-Cys | Tyr |
| — | Ala | D-Cys | Cys | Glu | Trp | Cys | Cys | Asn | Pro | Ala | Cys | Thr | Gly | Cys | — |
| — | Ala | D-Cys | Cys | Glu | Trp | Cys | Cys | Asn | Pro | Ala | Cys | Thr | Gly | Cys | Lys |
| — | Ala | D-Cys | Cys | Glu | Trp | Cys | Cys | Asn | Pro | Ala | Cys | Thr | Gly | Cys | Tyr |
| — | Ala | D-Cys | Cys | Glu | Trp | Cys | Cys | Asn | Pro | Ala | Cys | Thr | Gly | D-Cys | — |
| — | Ala | D-Cys | Cys | Glu | Trp | Cys | Cys | Asn | Pro | Ala | Cys | Thr | Gly | D-Cys | Lys |
| — | Ala | D-Cys | Cys | Glu | Trp | Cys | Cys | Asn | Pro | Ala | Cys | Thr | Gly | D-Cys | Tyr |
| — | Ala | D-Cys | Cys | Glu | Trp | Cys | Cys | Thr | Pro | Ala | Cys | Thr | Gly | Cys | — |
| — | Ala | D-Cys | Cys | Glu | Trp | Cys | Cys | Thr | Pro | Ala | Cys | Thr | Gly | Cys | Lys |
| — | Ala | D-Cys | Cys | Glu | Trp | Cys | Cys | Thr | Pro | Ala | Cys | Thr | Gly | Cys | Tyr |
| — | Ala | D-Cys | Cys | Glu | Trp | Cys | Cys | Thr | Pro | Ala | Cys | Thr | Gly | D-Cys | — |
| — | Ala | D-Cys | Cys | Glu | Trp | Cys | Cys | Thr | Pro | Ala | Cys | Thr | Gly | D-Cys | Lys |
| — | Ala | D-Cys | Cys | Glu | Trp | Cys | Cys | Thr | Pro | Ala | Cys | Thr | Gly | D-Cys | Tyr |
| — | Ala | D-Cys | Cys | Glu | Trp | D-Cys | Cys | Asn | Pro | Ala | Cys | Thr | Gly | Cys | — |
| — | Ala | D-Cys | Cys | Glu | Trp | D-Cys | Cys | Asn | Pro | Ala | Cys | Thr | Gly | Cys | Lys |
| — | Ala | D-Cys | Cys | Glu | Trp | D-Cys | Cys | Asn | Pro | Ala | Cys | Thr | Gly | Cys | Tyr |
| — | Ala | D-Cys | Cys | Glu | Trp | D-Cys | Cys | Asn | Pro | Ala | Cys | Thr | Gly | D-Cys | — |
| — | Ala | D-Cys | Cys | Glu | Trp | D-Cys | Cys | Asn | Pro | Ala | Cys | Thr | Gly | D-Cys | Lys |
| — | Ala | D-Cys | Cys | Glu | Trp | D-Cys | Cys | Asn | Pro | Ala | Cys | Thr | Gly | D-Cys | Tyr |
| — | Ala | D-Cys | Cys | Glu | Trp | D-Cys | Cys | Thr | Pro | Ala | Cys | Thr | Gly | Cys | — |
| — | Ala | D-Cys | Cys | Glu | Trp | D-Cys | Cys | Thr | Pro | Ala | Cys | Thr | Gly | Cys | Lys |
| — | Ala | D-Cys | Cys | Glu | Trp | D-Cys | Cys | Thr | Pro | Ala | Cys | Thr | Gly | Cys | Tyr |
| — | Ala | D-Cys | Cys | Glu | Trp | D-Cys | Cys | Thr | Pro | Ala | Cys | Thr | Gly | D-Cys | — |
| — | Ala | D-Cys | Cys | Glu | Trp | D-Cys | Cys | Thr | Pro | Ala | Cys | Thr | Gly | D-Cys | Lys |
| — | Ala | D-Cys | Cys | Glu | Trp | D-Cys | Cys | Thr | Pro | Ala | Cys | Thr | Gly | D-Cys | Tyr |
| — | Gly | Cys | Cys | Glu | Val | Cys | Cys | Asn | Pro | Ala | Cys | Thr | Gly | Cys | — |
| — | Gly | Cys | Cys | Glu | Val | Cys | Cys | Asn | Pro | Ala | Cys | Thr | Gly | Cys | Lys |
| — | Gly | Cys | Cys | Glu | Val | Cys | Cys | Asn | Pro | Ala | Cys | Thr | Gly | Cys | Tyr |
| — | Gly | Cys | Cys | Glu | Val | Cys | Cys | Asn | Pro | Ala | Cys | Thr | Gly | D-Cys | — |
| — | Gly | Cys | Cys | Glu | Val | Cys | Cys | Asn | Pro | Ala | Cys | Thr | Gly | D-Cys | Lys |
| — | Gly | Cys | Cys | Glu | Val | Cys | Cys | Asn | Pro | Ala | Cys | Thr | Gly | D-Cys | Tyr |
| — | Gly | Cys | Cys | Glu | Val | Cys | Cys | Thr | Pro | Ala | Cys | Thr | Gly | Cys | — |
| — | Gly | Cys | Cys | Glu | Val | Cys | Cys | Thr | Pro | Ala | Cys | Thr | Gly | Cys | Lys |
| — | Gly | Cys | Cys | Glu | Val | Cys | Cys | Thr | Pro | Ala | Cys | Thr | Gly | Cys | Tyr |
| — | Gly | Cys | Cys | Glu | Val | Cys | Cys | Thr | Pro | Ala | Cys | Thr | Gly | D-Cys | — |
| — | Gly | Cys | Cys | Glu | Val | Cys | Cys | Thr | Pro | Ala | Cys | Thr | Gly | D-Cys | Lys |
| — | Gly | Cys | Cys | Glu | Val | Cys | Cys | Thr | Pro | Ala | Cys | Thr | Gly | D-Cys | Tyr |
| — | Gly | Cys | Cys | Glu | Val | D-Cys | Cys | Asn | Pro | Ala | Cys | Thr | Gly | Cys | — |
| — | Gly | Cys | Cys | Glu | Val | D-Cys | Cys | Asn | Pro | Ala | Cys | Thr | Gly | Cys | Lys |
| — | Gly | Cys | Cys | Glu | Val | D-Cys | Cys | Asn | Pro | Ala | Cys | Thr | Gly | Cys | Tyr |
| — | Gly | Cys | Cys | Glu | Val | D-Cys | Cys | Asn | Pro | Ala | Cys | Thr | Gly | D-Cys | — |
| — | Gly | Cys | Cys | Glu | Val | D-Cys | Cys | Asn | Pro | Ala | Cys | Thr | Gly | D-Cys | Lys |
| — | Gly | Cys | Cys | Glu | Val | D-Cys | Cys | Asn | Pro | Ala | Cys | Thr | Gly | D-Cys | Tyr |
| — | Gly | Cys | Cys | Glu | Val | D-Cys | Cys | Thr | Pro | Ala | Cys | Thr | Gly | Cys | — |
| — | Gly | Cys | Cys | Glu | Val | D-Cys | Cys | Thr | Pro | Ala | Cys | Thr | Gly | Cys | Lys |
| — | Gly | Cys | Cys | Glu | Val | D-Cys | Cys | Thr | Pro | Ala | Cys | Thr | Gly | Cys | Tyr |
| — | Gly | Cys | Cys | Glu | Val | D-Cys | Cys | Thr | Pro | Ala | Cys | Thr | Gly | D-Cys | — |
| — | Gly | Cys | Cys | Glu | Val | D-Cys | Cys | Thr | Pro | Ala | Cys | Thr | Gly | D-Cys | Lys |
| — | Gly | Cys | Cys | Glu | Val | D-Cys | Cys | Thr | Pro | Ala | Cys | Thr | Gly | D-Cys | Tyr |
| — | Gly | Cys | Cys | Glu | Ile | Cys | Cys | Asn | Pro | Ala | Cys | Thr | Gly | Cys | — |
| — | Gly | Cys | Cys | Glu | Ile | Cys | Cys | Asn | Pro | Ala | Cys | Thr | Gly | Cys | Lys |
| — | Gly | Cys | Cys | Glu | Ile | Cys | Cys | Asn | Pro | Ala | Cys | Thr | Gly | Cys | Tyr |

FIG. 3A-10

| | | | | | | | | | | | | | |
|---|---|---|---|---|---|---|---|---|---|---|---|---|---|
| — | Gly | Cys | Cys | Glu | Ile | Cys | Cys | Asn | Pro | Ala | Cys | Thr | Gly | D-Cys | — |
| — | Gly | Cys | Cys | Glu | Ile | Cys | Cys | Asn | Pro | Ala | Cys | Thr | Gly | D-Cys | Lys |
| — | Gly | Cys | Cys | Glu | Ile | Cys | Cys | Asn | Pro | Ala | Cys | Thr | Gly | D-Cys | Tyr |
| — | Gly | Cys | Cys | Glu | Ile | Cys | Cys | Thr | Pro | Ala | Cys | Thr | Gly | Cys | — |
| — | Gly | Cys | Cys | Glu | Ile | Cys | Cys | Thr | Pro | Ala | Cys | Thr | Gly | Cys | Lys |
| — | Gly | Cys | Cys | Glu | Ile | Cys | Cys | Thr | Pro | Ala | Cys | Thr | Gly | Cys | Tyr |
| — | Gly | Cys | Cys | Glu | Ile | Cys | Cys | Thr | Pro | Ala | Cys | Thr | Gly | D-Cys | — |
| — | Gly | Cys | Cys | Glu | Ile | Cys | Cys | Thr | Pro | Ala | Cys | Thr | Gly | D-Cys | Lys |
| — | Gly | Cys | Cys | Glu | Ile | Cys | Cys | Thr | Pro | Ala | Cys | Thr | Gly | D-Cys | Tyr |
| — | Gly | Cys | Cys | Glu | Ile | D-Cys | Cys | Asn | Pro | Ala | Cys | Thr | Gly | Cys | — |
| — | Gly | Cys | Cys | Glu | Ile | D-Cys | Cys | Asn | Pro | Ala | Cys | Thr | Gly | Cys | Lys |
| — | Gly | Cys | Cys | Glu | Ile | D-Cys | Cys | Asn | Pro | Ala | Cys | Thr | Gly | Cys | Tyr |
| — | Gly | Cys | Cys | Glu | Ile | D-Cys | Cys | Asn | Pro | Ala | Cys | Thr | Gly | D-Cys | — |
| — | Gly | Cys | Cys | Glu | Ile | D-Cys | Cys | Asn | Pro | Ala | Cys | Thr | Gly | D-Cys | Lys |
| — | Gly | Cys | Cys | Glu | Ile | D-Cys | Cys | Asn | Pro | Ala | Cys | Thr | Gly | D-Cys | Tyr |
| — | Gly | Cys | Cys | Glu | Ile | D-Cys | Cys | Thr | Pro | Ala | Cys | Thr | Gly | Cys | — |
| — | Gly | Cys | Cys | Glu | Ile | D-Cys | Cys | Thr | Pro | Ala | Cys | Thr | Gly | Cys | Lys |
| — | Gly | Cys | Cys | Glu | Ile | D-Cys | Cys | Thr | Pro | Ala | Cys | Thr | Gly | Cys | Tyr |
| — | Gly | Cys | Cys | Glu | Ile | D-Cys | Cys | Thr | Pro | Ala | Cys | Thr | Gly | D-Cys | — |
| — | Gly | Cys | Cys | Glu | Ile | D-Cys | Cys | Thr | Pro | Ala | Cys | Thr | Gly | D-Cys | Lys |
| — | Gly | Cys | Cys | Glu | Ile | D-Cys | Cys | Thr | Pro | Ala | Cys | Thr | Gly | D-Cys | Tyr |
| — | Gly | Cys | Cys | Glu | Leu | Cys | Cys | Asn | Pro | Ala | Cys | Thr | Gly | Cys | — |
| — | Gly | Cys | Cys | Glu | Leu | Cys | Cys | Asn | Pro | Ala | Cys | Thr | Gly | Cys | Lys |
| — | Gly | Cys | Cys | Glu | Leu | Cys | Cys | Asn | Pro | Ala | Cys | Thr | Gly | Cys | Tyr |
| — | Gly | Cys | Cys | Glu | Leu | Cys | Cys | Asn | Pro | Ala | Cys | Thr | Gly | D-Cys | — |
| — | Gly | Cys | Cys | Glu | Leu | Cys | Cys | Asn | Pro | Ala | Cys | Thr | Gly | D-Cys | Lys |
| — | Gly | Cys | Cys | Glu | Leu | Cys | Cys | Asn | Pro | Ala | Cys | Thr | Gly | D-Cys | Tyr |
| — | Gly | Cys | Cys | Glu | Leu | Cys | Cys | Thr | Pro | Ala | Cys | Thr | Gly | Cys | — |
| — | Gly | Cys | Cys | Glu | Leu | Cys | Cys | Thr | Pro | Ala | Cys | Thr | Gly | Cys | Lys |
| — | Gly | Cys | Cys | Glu | Leu | Cys | Cys | Thr | Pro | Ala | Cys | Thr | Gly | Cys | Tyr |
| — | Gly | Cys | Cys | Glu | Leu | Cys | Cys | Thr | Pro | Ala | Cys | Thr | Gly | D-Cys | — |
| — | Gly | Cys | Cys | Glu | Leu | Cys | Cys | Thr | Pro | Ala | Cys | Thr | Gly | D-Cys | Lys |
| — | Gly | Cys | Cys | Glu | Leu | Cys | Cys | Thr | Pro | Ala | Cys | Thr | Gly | D-Cys | Tyr |
| — | Gly | Cys | Cys | Glu | Leu | D-Cys | Cys | Asn | Pro | Ala | Cys | Thr | Gly | Cys | — |
| — | Gly | Cys | Cys | Glu | Leu | D-Cys | Cys | Asn | Pro | Ala | Cys | Thr | Gly | Cys | Lys |
| — | Gly | Cys | Cys | Glu | Leu | D-Cys | Cys | Asn | Pro | Ala | Cys | Thr | Gly | Cys | Tyr |
| — | Gly | Cys | Cys | Glu | Leu | D-Cys | Cys | Asn | Pro | Ala | Cys | Thr | Gly | D-Cys | — |
| — | Gly | Cys | Cys | Glu | Leu | D-Cys | Cys | Asn | Pro | Ala | Cys | Thr | Gly | D-Cys | Lys |
| — | Gly | Cys | Cys | Glu | Leu | D-Cys | Cys | Asn | Pro | Ala | Cys | Thr | Gly | D-Cys | Tyr |
| — | Gly | Cys | Cys | Glu | Leu | D-Cys | Cys | Thr | Pro | Ala | Cys | Thr | Gly | Cys | — |
| — | Gly | Cys | Cys | Glu | Leu | D-Cys | Cys | Thr | Pro | Ala | Cys | Thr | Gly | Cys | Lys |
| — | Gly | Cys | Cys | Glu | Leu | D-Cys | Cys | Thr | Pro | Ala | Cys | Thr | Gly | Cys | Tyr |
| — | Gly | Cys | Cys | Glu | Leu | D-Cys | Cys | Thr | Pro | Ala | Cys | Thr | Gly | D-Cys | — |
| — | Gly | Cys | Cys | Glu | Leu | D-Cys | Cys | Thr | Pro | Ala | Cys | Thr | Gly | D-Cys | Lys |
| — | Gly | Cys | Cys | Glu | Leu | D-Cys | Cys | Thr | Pro | Ala | Cys | Thr | Gly | D-Cys | Tyr |
| — | Gly | Cys | Cys | Glu | Tyr | Cys | Cys | Asn | Pro | Ala | Cys | Thr | Gly | Cys | — |
| — | Gly | Cys | Cys | Glu | Tyr | Cys | Cys | Asn | Pro | Ala | Cys | Thr | Gly | Cys | Lys |
| — | Gly | Cys | Cys | Glu | Tyr | Cys | Cys | Asn | Pro | Ala | Cys | Thr | Gly | Cys | Tyr |
| — | Gly | Cys | Cys | Glu | Tyr | Cys | Cys | Asn | Pro | Ala | Cys | Thr | Gly | D-Cys | — |
| — | Gly | Cys | Cys | Glu | Tyr | Cys | Cys | Asn | Pro | Ala | Cys | Thr | Gly | D-Cys | Lys |
| — | Gly | Cys | Cys | Glu | Tyr | Cys | Cys | Asn | Pro | Ala | Cys | Thr | Gly | D-Cys | Tyr |
| — | Gly | Cys | Cys | Glu | Tyr | Cys | Cys | Thr | Pro | Ala | Cys | Thr | Gly | Cys | — |
| — | Gly | Cys | Cys | Glu | Tyr | Cys | Cys | Thr | Pro | Ala | Cys | Thr | Gly | Cys | Lys |
| — | Gly | Cys | Cys | Glu | Tyr | Cys | Cys | Thr | Pro | Ala | Cys | Thr | Gly | Cys | Tyr |
| — | Gly | Cys | Cys | Glu | Tyr | Cys | Cys | Thr | Pro | Ala | Cys | Thr | Gly | D-Cys | — |
| — | Gly | Cys | Cys | Glu | Tyr | Cys | Cys | Thr | Pro | Ala | Cys | Thr | Gly | D-Cys | Lys |
| — | Gly | Cys | Cys | Glu | Tyr | Cys | Cys | Thr | Pro | Ala | Cys | Thr | Gly | D-Cys | Tyr |
| — | Gly | Cys | Cys | Glu | Tyr | D-Cys | Cys | Asn | Pro | Ala | Cys | Thr | Gly | Cys | — |
| — | Gly | Cys | Cys | Glu | Tyr | D-Cys | Cys | Asn | Pro | Ala | Cys | Thr | Gly | Cys | Lys |
| — | Gly | Cys | Cys | Glu | Tyr | D-Cys | Cys | Asn | Pro | Ala | Cys | Thr | Gly | Cys | Tyr |

FIG. 3A-11

| | | | | | | | | | | | | | | |
|---|---|---|---|---|---|---|---|---|---|---|---|---|---|---|
| — | Gly | Cys | Cys | Glu | Tyr | D-Cys | Cys | Asn | Pro | Ala | Cys | Thr | Gly | D-Cys | — |
| — | Gly | Cys | Cys | Glu | Tyr | D-Cys | Cys | Asn | Pro | Ala | Cys | Thr | Gly | D-Cys | Lys |
| — | Gly | Cys | Cys | Glu | Tyr | D-Cys | Cys | Asn | Pro | Ala | Cys | Thr | Gly | D-Cys | Tyr |
| — | Gly | Cys | Cys | Glu | Tyr | D-Cys | Cys | Thr | Pro | Ala | Cys | Thr | Gly | Cys | — |
| — | Gly | Cys | Cys | Glu | Tyr | D-Cys | Cys | Thr | Pro | Ala | Cys | Thr | Gly | Cys | Lys |
| — | Gly | Cys | Cys | Glu | Tyr | D-Cys | Cys | Thr | Pro | Ala | Cys | Thr | Gly | Cys | Tyr |
| — | Gly | Cys | Cys | Glu | Tyr | D-Cys | Cys | Thr | Pro | Ala | Cys | Thr | Gly | D-Cys | — |
| — | Gly | Cys | Cys | Glu | Tyr | D-Cys | Cys | Thr | Pro | Ala | Cys | Thr | Gly | D-Cys | Lys |
| — | Gly | Cys | Cys | Glu | Tyr | D-Cys | Cys | Thr | Pro | Ala | Cys | Thr | Gly | D-Cys | Tyr |
| — | Gly | Cys | Cys | Glu | Phe | Cys | Cys | Asn | Pro | Ala | Cys | Thr | Gly | Cys | — |
| — | Gly | Cys | Cys | Glu | Phe | Cys | Cys | Asn | Pro | Ala | Cys | Thr | Gly | Cys | Lys |
| — | Gly | Cys | Cys | Glu | Phe | Cys | Cys | Asn | Pro | Ala | Cys | Thr | Gly | Cys | Tyr |
| — | Gly | Cys | Cys | Glu | Phe | Cys | Cys | Asn | Pro | Ala | Cys | Thr | Gly | D-Cys | — |
| — | Gly | Cys | Cys | Glu | Phe | Cys | Cys | Asn | Pro | Ala | Cys | Thr | Gly | D-Cys | Lys |
| — | Gly | Cys | Cys | Glu | Phe | Cys | Cys | Asn | Pro | Ala | Cys | Thr | Gly | D-Cys | Tyr |
| — | Gly | Cys | Cys | Glu | Phe | Cys | Cys | Thr | Pro | Ala | Cys | Thr | Gly | Cys | — |
| — | Gly | Cys | Cys | Glu | Phe | Cys | Cys | Thr | Pro | Ala | Cys | Thr | Gly | Cys | Lys |
| — | Gly | Cys | Cys | Glu | Phe | Cys | Cys | Thr | Pro | Ala | Cys | Thr | Gly | Cys | Tyr |
| — | Gly | Cys | Cys | Glu | Phe | Cys | Cys | Thr | Pro | Ala | Cys | Thr | Gly | D-Cys | — |
| — | Gly | Cys | Cys | Glu | Phe | Cys | Cys | Thr | Pro | Ala | Cys | Thr | Gly | D-Cys | Lys |
| — | Gly | Cys | Cys | Glu | Phe | Cys | Cys | Thr | Pro | Ala | Cys | Thr | Gly | D-Cys | Tyr |
| — | Gly | Cys | Cys | Glu | Phe | D-Cys | Cys | Asn | Pro | Ala | Cys | Thr | Gly | Cys | — |
| — | Gly | Cys | Cys | Glu | Phe | D-Cys | Cys | Asn | Pro | Ala | Cys | Thr | Gly | Cys | Lys |
| — | Gly | Cys | Cys | Glu | Phe | D-Cys | Cys | Asn | Pro | Ala | Cys | Thr | Gly | Cys | Tyr |
| — | Gly | Cys | Cys | Glu | Phe | D-Cys | Cys | Asn | Pro | Ala | Cys | Thr | Gly | D-Cys | — |
| — | Gly | Cys | Cys | Glu | Phe | D-Cys | Cys | Asn | Pro | Ala | Cys | Thr | Gly | D-Cys | Lys |
| — | Gly | Cys | Cys | Glu | Phe | D-Cys | Cys | Asn | Pro | Ala | Cys | Thr | Gly | D-Cys | Tyr |
| — | Gly | Cys | Cys | Glu | Phe | D-Cys | Cys | Thr | Pro | Ala | Cys | Thr | Gly | Cys | — |
| — | Gly | Cys | Cys | Glu | Phe | D-Cys | Cys | Thr | Pro | Ala | Cys | Thr | Gly | Cys | Lys |
| — | Gly | Cys | Cys | Glu | Phe | D-Cys | Cys | Thr | Pro | Ala | Cys | Thr | Gly | Cys | Tyr |
| — | Gly | Cys | Cys | Glu | Phe | D-Cys | Cys | Thr | Pro | Ala | Cys | Thr | Gly | D-Cys | — |
| — | Gly | Cys | Cys | Glu | Phe | D-Cys | Cys | Thr | Pro | Ala | Cys | Thr | Gly | D-Cys | Lys |
| — | Gly | Cys | Cys | Glu | Phe | D-Cys | Cys | Thr | Pro | Ala | Cys | Thr | Gly | D-Cys | Tyr |
| — | Gly | Cys | Cys | Glu | Trp | Cys | Cys | Asn | Pro | Ala | Cys | Thr | Gly | Cys | — |
| — | Gly | Cys | Cys | Glu | Trp | Cys | Cys | Asn | Pro | Ala | Cys | Thr | Gly | Cys | Lys |
| — | Gly | Cys | Cys | Glu | Trp | Cys | Cys | Asn | Pro | Ala | Cys | Thr | Gly | Cys | Tyr |
| — | Gly | Cys | Cys | Glu | Trp | Cys | Cys | Asn | Pro | Ala | Cys | Thr | Gly | D-Cys | — |
| — | Gly | Cys | Cys | Glu | Trp | Cys | Cys | Asn | Pro | Ala | Cys | Thr | Gly | D-Cys | Lys |
| — | Gly | Cys | Cys | Glu | Trp | Cys | Cys | Asn | Pro | Ala | Cys | Thr | Gly | D-Cys | Tyr |
| — | Gly | Cys | Cys | Glu | Trp | Cys | Cys | Thr | Pro | Ala | Cys | Thr | Gly | Cys | — |
| — | Gly | Cys | Cys | Glu | Trp | Cys | Cys | Thr | Pro | Ala | Cys | Thr | Gly | Cys | Lys |
| — | Gly | Cys | Cys | Glu | Trp | Cys | Cys | Thr | Pro | Ala | Cys | Thr | Gly | Cys | Tyr |
| — | Gly | Cys | Cys | Glu | Trp | Cys | Cys | Thr | Pro | Ala | Cys | Thr | Gly | D-Cys | — |
| — | Gly | Cys | Cys | Glu | Trp | Cys | Cys | Thr | Pro | Ala | Cys | Thr | Gly | D-Cys | Lys |
| — | Gly | Cys | Cys | Glu | Trp | Cys | Cys | Thr | Pro | Ala | Cys | Thr | Gly | D-Cys | Tyr |
| — | Gly | Cys | Cys | Glu | Trp | D-Cys | Cys | Asn | Pro | Ala | Cys | Thr | Gly | Cys | — |
| — | Gly | Cys | Cys | Glu | Trp | D-Cys | Cys | Asn | Pro | Ala | Cys | Thr | Gly | Cys | Lys |
| — | Gly | Cys | Cys | Glu | Trp | D-Cys | Cys | Asn | Pro | Ala | Cys | Thr | Gly | Cys | Tyr |
| — | Gly | Cys | Cys | Glu | Trp | D-Cys | Cys | Asn | Pro | Ala | Cys | Thr | Gly | D-Cys | — |
| — | Gly | Cys | Cys | Glu | Trp | D-Cys | Cys | Asn | Pro | Ala | Cys | Thr | Gly | D-Cys | Lys |
| — | Gly | Cys | Cys | Glu | Trp | D-Cys | Cys | Asn | Pro | Ala | Cys | Thr | Gly | D-Cys | Tyr |
| — | Gly | Cys | Cys | Glu | Trp | D-Cys | Cys | Thr | Pro | Ala | Cys | Thr | Gly | Cys | — |
| — | Gly | Cys | Cys | Glu | Trp | D-Cys | Cys | Thr | Pro | Ala | Cys | Thr | Gly | Cys | Lys |
| — | Gly | Cys | Cys | Glu | Trp | D-Cys | Cys | Thr | Pro | Ala | Cys | Thr | Gly | Cys | Tyr |
| — | Gly | Cys | Cys | Glu | Trp | D-Cys | Cys | Thr | Pro | Ala | Cys | Thr | Gly | D-Cys | — |
| — | Gly | Cys | Cys | Glu | Trp | D-Cys | Cys | Thr | Pro | Ala | Cys | Thr | Gly | D-Cys | Lys |
| — | Gly | Cys | Cys | Glu | Trp | D-Cys | Cys | Thr | Pro | Ala | Cys | Thr | Gly | D-Cys | Tyr |
| — | Gly | D-Cys | Cys | Glu | Val | Cys | Cys | Asn | Pro | Ala | Cys | Thr | Gly | Cys | — |
| — | Gly | D-Cys | Cys | Glu | Val | Cys | Cys | Asn | Pro | Ala | Cys | Thr | Gly | Cys | Lys |
| — | Gly | D-Cys | Cys | Glu | Val | Cys | Cys | Asn | Pro | Ala | Cys | Thr | Gly | Cys | Tyr |

FIG. 3A-12

| | | | | | | | | | | | | | | |
|---|---|---|---|---|---|---|---|---|---|---|---|---|---|---|
| — | Gly | D-Cys | Cys | Glu | Val | Cys | Cys | Asn | Pro | Ala | Cys | Thr | Gly | D-Cys | — |
| — | Gly | D-Cys | Cys | Glu | Val | Cys | Cys | Asn | Pro | Ala | Cys | Thr | Gly | D-Cys | Lys |
| — | Gly | D-Cys | Cys | Glu | Val | Cys | Cys | Asn | Pro | Ala | Cys | Thr | Gly | D-Cys | Tyr |
| — | Gly | D-Cys | Cys | Glu | Val | Cys | Cys | Thr | Pro | Ala | Cys | Thr | Gly | Cys | — |
| — | Gly | D-Cys | Cys | Glu | Val | Cys | Cys | Thr | Pro | Ala | Cys | Thr | Gly | Cys | Lys |
| — | Gly | D-Cys | Cys | Glu | Val | Cys | Cys | Thr | Pro | Ala | Cys | Thr | Gly | Cys | Tyr |
| — | Gly | D-Cys | Cys | Glu | Val | Cys | Cys | Thr | Pro | Ala | Cys | Thr | Gly | D-Cys | — |
| — | Gly | D-Cys | Cys | Glu | Val | Cys | Cys | Thr | Pro | Ala | Cys | Thr | Gly | D-Cys | Lys |
| — | Gly | D-Cys | Cys | Glu | Val | Cys | Cys | Thr | Pro | Ala | Cys | Thr | Gly | D-Cys | Tyr |
| — | Gly | D-Cys | Cys | Glu | Val | D-Cys | Cys | Asn | Pro | Ala | Cys | Thr | Gly | Cys | — |
| — | Gly | D-Cys | Cys | Glu | Val | D-Cys | Cys | Asn | Pro | Ala | Cys | Thr | Gly | Cys | Lys |
| — | Gly | D-Cys | Cys | Glu | Val | D-Cys | Cys | Asn | Pro | Ala | Cys | Thr | Gly | Cys | Tyr |
| — | Gly | D-Cys | Cys | Glu | Val | D-Cys | Cys | Asn | Pro | Ala | Cys | Thr | Gly | D-Cys | — |
| — | Gly | D-Cys | Cys | Glu | Val | D-Cys | Cys | Asn | Pro | Ala | Cys | Thr | Gly | D-Cys | Lys |
| — | Gly | D-Cys | Cys | Glu | Val | D-Cys | Cys | Asn | Pro | Ala | Cys | Thr | Gly | D-Cys | Tyr |
| — | Gly | D-Cys | Cys | Glu | Val | D-Cys | Cys | Thr | Pro | Ala | Cys | Thr | Gly | Cys | — |
| — | Gly | D-Cys | Cys | Glu | Val | D-Cys | Cys | Thr | Pro | Ala | Cys | Thr | Gly | Cys | Lys |
| — | Gly | D-Cys | Cys | Glu | Val | D-Cys | Cys | Thr | Pro | Ala | Cys | Thr | Gly | Cys | Tyr |
| — | Gly | D-Cys | Cys | Glu | Val | D-Cys | Cys | Thr | Pro | Ala | Cys | Thr | Gly | D-Cys | — |
| — | Gly | D-Cys | Cys | Glu | Val | D-Cys | Cys | Thr | Pro | Ala | Cys | Thr | Gly | D-Cys | Lys |
| — | Gly | D-Cys | Cys | Glu | Val | D-Cys | Cys | Thr | Pro | Ala | Cys | Thr | Gly | D-Cys | Tyr |
| — | Gly | D-Cys | Cys | Glu | Ile | Cys | Cys | Asn | Pro | Ala | Cys | Thr | Gly | Cys | — |
| — | Gly | D-Cys | Cys | Glu | Ile | Cys | Cys | Asn | Pro | Ala | Cys | Thr | Gly | Cys | Lys |
| — | Gly | D-Cys | Cys | Glu | Ile | Cys | Cys | Asn | Pro | Ala | Cys | Thr | Gly | Cys | Tyr |
| — | Gly | D-Cys | Cys | Glu | Ile | Cys | Cys | Asn | Pro | Ala | Cys | Thr | Gly | D-Cys | — |
| — | Gly | D-Cys | Cys | Glu | Ile | Cys | Cys | Asn | Pro | Ala | Cys | Thr | Gly | D-Cys | Lys |
| — | Gly | D-Cys | Cys | Glu | Ile | Cys | Cys | Asn | Pro | Ala | Cys | Thr | Gly | D-Cys | Tyr |
| — | Gly | D-Cys | Cys | Glu | Ile | Cys | Cys | Thr | Pro | Ala | Cys | Thr | Gly | Cys | — |
| — | Gly | D-Cys | Cys | Glu | Ile | Cys | Cys | Thr | Pro | Ala | Cys | Thr | Gly | Cys | Lys |
| — | Gly | D-Cys | Cys | Glu | Ile | Cys | Cys | Thr | Pro | Ala | Cys | Thr | Gly | Cys | Tyr |
| — | Gly | D-Cys | Cys | Glu | Ile | Cys | Cys | Thr | Pro | Ala | Cys | Thr | Gly | D-Cys | — |
| — | Gly | D-Cys | Cys | Glu | Ile | Cys | Cys | Thr | Pro | Ala | Cys | Thr | Gly | D-Cys | Lys |
| — | Gly | D-Cys | Cys | Glu | Ile | Cys | Cys | Thr | Pro | Ala | Cys | Thr | Gly | D-Cys | Tyr |
| — | Gly | D-Cys | Cys | Glu | Ile | D-Cys | Cys | Asn | Pro | Ala | Cys | Thr | Gly | Cys | — |
| — | Gly | D-Cys | Cys | Glu | Ile | D-Cys | Cys | Asn | Pro | Ala | Cys | Thr | Gly | Cys | Lys |
| — | Gly | D-Cys | Cys | Glu | Ile | D-Cys | Cys | Asn | Pro | Ala | Cys | Thr | Gly | Cys | Tyr |
| — | Gly | D-Cys | Cys | Glu | Ile | D-Cys | Cys | Asn | Pro | Ala | Cys | Thr | Gly | D-Cys | — |
| — | Gly | D-Cys | Cys | Glu | Ile | D-Cys | Cys | Asn | Pro | Ala | Cys | Thr | Gly | D-Cys | Lys |
| — | Gly | D-Cys | Cys | Glu | Ile | D-Cys | Cys | Asn | Pro | Ala | Cys | Thr | Gly | D-Cys | Tyr |
| — | Gly | D-Cys | Cys | Glu | Ile | D-Cys | Cys | Thr | Pro | Ala | Cys | Thr | Gly | Cys | — |
| — | Gly | D-Cys | Cys | Glu | Ile | D-Cys | Cys | Thr | Pro | Ala | Cys | Thr | Gly | Cys | Lys |
| — | Gly | D-Cys | Cys | Glu | Ile | D-Cys | Cys | Thr | Pro | Ala | Cys | Thr | Gly | Cys | Tyr |
| — | Gly | D-Cys | Cys | Glu | Ile | D-Cys | Cys | Thr | Pro | Ala | Cys | Thr | Gly | D-Cys | — |
| — | Gly | D-Cys | Cys | Glu | Ile | D-Cys | Cys | Thr | Pro | Ala | Cys | Thr | Gly | D-Cys | Lys |
| — | Gly | D-Cys | Cys | Glu | Ile | D-Cys | Cys | Thr | Pro | Ala | Cys | Thr | Gly | D-Cys | Tyr |
| — | Gly | D-Cys | Cys | Glu | Leu | Cys | Cys | Asn | Pro | Ala | Cys | Thr | Gly | Cys | — |
| — | Gly | D-Cys | Cys | Glu | Leu | Cys | Cys | Asn | Pro | Ala | Cys | Thr | Gly | Cys | Lys |
| — | Gly | D-Cys | Cys | Glu | Leu | Cys | Cys | Asn | Pro | Ala | Cys | Thr | Gly | Cys | Tyr |
| — | Gly | D-Cys | Cys | Glu | Leu | Cys | Cys | Asn | Pro | Ala | Cys | Thr | Gly | D-Cys | — |
| — | Gly | D-Cys | Cys | Glu | Leu | Cys | Cys | Asn | Pro | Ala | Cys | Thr | Gly | D-Cys | Lys |
| — | Gly | D-Cys | Cys | Glu | Leu | Cys | Cys | Asn | Pro | Ala | Cys | Thr | Gly | D-Cys | Tyr |
| — | Gly | D-Cys | Cys | Glu | Leu | Cys | Cys | Thr | Pro | Ala | Cys | Thr | Gly | Cys | — |
| — | Gly | D-Cys | Cys | Glu | Leu | Cys | Cys | Thr | Pro | Ala | Cys | Thr | Gly | Cys | Lys |
| — | Gly | D-Cys | Cys | Glu | Leu | Cys | Cys | Thr | Pro | Ala | Cys | Thr | Gly | Cys | Tyr |
| — | Gly | D-Cys | Cys | Glu | Leu | Cys | Cys | Thr | Pro | Ala | Cys | Thr | Gly | D-Cys | — |
| — | Gly | D-Cys | Cys | Glu | Leu | Cys | Cys | Thr | Pro | Ala | Cys | Thr | Gly | D-Cys | Lys |
| — | Gly | D-Cys | Cys | Glu | Leu | Cys | Cys | Thr | Pro | Ala | Cys | Thr | Gly | D-Cys | Tyr |
| — | Gly | D-Cys | Cys | Glu | Leu | D-Cys | Cys | Asn | Pro | Ala | Cys | Thr | Gly | Cys | — |
| — | Gly | D-Cys | Cys | Glu | Leu | D-Cys | Cys | Asn | Pro | Ala | Cys | Thr | Gly | Cys | Lys |
| — | Gly | D-Cys | Cys | Glu | Leu | D-Cys | Cys | Asn | Pro | Ala | Cys | Thr | Gly | Cys | Tyr |

FIG. 3A-13

| | Gly | D-Cys | Cys | Glu | Leu | D-Cys | Cys | Asn | Pro | Ala | Cys | Thr | Gly | D-Cys | --- |
|---|---|---|---|---|---|---|---|---|---|---|---|---|---|---|---|
| — | Gly | D-Cys | Cys | Glu | Leu | D-Cys | Cys | Asn | Pro | Ala | Cys | Thr | Gly | D-Cys | Lys |
| — | Gly | D-Cys | Cys | Glu | Leu | D-Cys | Cys | Asn | Pro | Ala | Cys | Thr | Gly | D-Cys | Tyr |
| — | Gly | D-Cys | Cys | Glu | Leu | D-Cys | Cys | Thr | Pro | Ala | Cys | Thr | Gly | Cys | — |
| — | Gly | D-Cys | Cys | Glu | Leu | D-Cys | Cys | Thr | Pro | Ala | Cys | Thr | Gly | Cys | Lys |
| — | Gly | D-Cys | Cys | Glu | Leu | D-Cys | Cys | Thr | Pro | Ala | Cys | Thr | Gly | Cys | Tyr |
| — | Gly | D-Cys | Cys | Glu | Leu | D-Cys | Cys | Thr | Pro | Ala | Cys | Thr | Gly | D-Cys | — |
| — | Gly | D-Cys | Cys | Glu | Leu | D-Cys | Cys | Thr | Pro | Ala | Cys | Thr | Gly | D-Cys | Lys |
| — | Gly | D-Cys | Cys | Glu | Leu | D-Cys | Cys | Thr | Pro | Ala | Cys | Thr | Gly | D-Cys | Tyr |
| — | Gly | D-Cys | Cys | Glu | Tyr | Cys | Cys | Asn | Pro | Ala | Cys | Thr | Gly | Cys | — |
| — | Gly | D-Cys | Cys | Glu | Tyr | Cys | Cys | Asn | Pro | Ala | Cys | Thr | Gly | Cys | Lys |
| — | Gly | D-Cys | Cys | Glu | Tyr | Cys | Cys | Asn | Pro | Ala | Cys | Thr | Gly | Cys | Tyr |
| — | Gly | D-Cys | Cys | Glu | Tyr | Cys | Cys | Asn | Pro | Ala | Cys | Thr | Gly | D-Cys | — |
| — | Gly | D-Cys | Cys | Glu | Tyr | Cys | Cys | Asn | Pro | Ala | Cys | Thr | Gly | D-Cys | Lys |
| — | Gly | D-Cys | Cys | Glu | Tyr | Cys | Cys | Asn | Pro | Ala | Cys | Thr | Gly | D-Cys | Tyr |
| — | Gly | D-Cys | Cys | Glu | Tyr | Cys | Cys | Thr | Pro | Ala | Cys | Thr | Gly | Cys | — |
| — | Gly | D-Cys | Cys | Glu | Tyr | Cys | Cys | Thr | Pro | Ala | Cys | Thr | Gly | Cys | Lys |
| — | Gly | D-Cys | Cys | Glu | Tyr | Cys | Cys | Thr | Pro | Ala | Cys | Thr | Gly | Cys | Tyr |
| — | Gly | D-Cys | Cys | Glu | Tyr | Cys | Cys | Thr | Pro | Ala | Cys | Thr | Gly | D-Cys | — |
| — | Gly | D-Cys | Cys | Glu | Tyr | Cys | Cys | Thr | Pro | Ala | Cys | Thr | Gly | D-Cys | Lys |
| — | Gly | D-Cys | Cys | Glu | Tyr | Cys | Cys | Thr | Pro | Ala | Cys | Thr | Gly | D-Cys | Tyr |
| — | Gly | D-Cys | Cys | Glu | Tyr | D-Cys | Cys | Asn | Pro | Ala | Cys | Thr | Gly | Cys | — |
| — | Gly | D-Cys | Cys | Glu | Tyr | D-Cys | Cys | Asn | Pro | Ala | Cys | Thr | Gly | Cys | Lys |
| — | Gly | D-Cys | Cys | Glu | Tyr | D-Cys | Cys | Asn | Pro | Ala | Cys | Thr | Gly | Cys | Tyr |
| — | Gly | D-Cys | Cys | Glu | Tyr | D-Cys | Cys | Asn | Pro | Ala | Cys | Thr | Gly | D-Cys | — |
| — | Gly | D-Cys | Cys | Glu | Tyr | D-Cys | Cys | Asn | Pro | Ala | Cys | Thr | Gly | D-Cys | Lys |
| — | Gly | D-Cys | Cys | Glu | Tyr | D-Cys | Cys | Asn | Pro | Ala | Cys | Thr | Gly | D-Cys | Tyr |
| — | Gly | D-Cys | Cys | Glu | Tyr | D-Cys | Cys | Thr | Pro | Ala | Cys | Thr | Gly | Cys | — |
| — | Gly | D-Cys | Cys | Glu | Tyr | D-Cys | Cys | Thr | Pro | Ala | Cys | Thr | Gly | Cys | Lys |
| — | Gly | D-Cys | Cys | Glu | Tyr | D-Cys | Cys | Thr | Pro | Ala | Cys | Thr | Gly | Cys | Tyr |
| — | Gly | D-Cys | Cys | Glu | Tyr | D-Cys | Cys | Thr | Pro | Ala | Cys | Thr | Gly | D-Cys | — |
| — | Gly | D-Cys | Cys | Glu | Tyr | D-Cys | Cys | Thr | Pro | Ala | Cys | Thr | Gly | D-Cys | Lys |
| — | Gly | D-Cys | Cys | Glu | Tyr | D-Cys | Cys | Thr | Pro | Ala | Cys | Thr | Gly | D-Cys | Tyr |
| — | Gly | D-Cys | Cys | Glu | Phe | Cys | Cys | Asn | Pro | Ala | Cys | Thr | Gly | Cys | — |
| — | Gly | D-Cys | Cys | Glu | Phe | Cys | Cys | Asn | Pro | Ala | Cys | Thr | Gly | Cys | Lys |
| — | Gly | D-Cys | Cys | Glu | Phe | Cys | Cys | Asn | Pro | Ala | Cys | Thr | Gly | Cys | Tyr |
| — | Gly | D-Cys | Cys | Glu | Phe | Cys | Cys | Asn | Pro | Ala | Cys | Thr | Gly | D-Cys | — |
| — | Gly | D-Cys | Cys | Glu | Phe | Cys | Cys | Asn | Pro | Ala | Cys | Thr | Gly | D-Cys | Lys |
| — | Gly | D-Cys | Cys | Glu | Phe | Cys | Cys | Asn | Pro | Ala | Cys | Thr | Gly | D-Cys | Tyr |
| — | Gly | D-Cys | Cys | Glu | Phe | Cys | Cys | Thr | Pro | Ala | Cys | Thr | Gly | Cys | — |
| — | Gly | D-Cys | Cys | Glu | Phe | Cys | Cys | Thr | Pro | Ala | Cys | Thr | Gly | Cys | Lys |
| — | Gly | D-Cys | Cys | Glu | Phe | Cys | Cys | Thr | Pro | Ala | Cys | Thr | Gly | Cys | Tyr |
| — | Gly | D-Cys | Cys | Glu | Phe | Cys | Cys | Thr | Pro | Ala | Cys | Thr | Gly | D-Cys | — |
| — | Gly | D-Cys | Cys | Glu | Phe | Cys | Cys | Thr | Pro | Ala | Cys | Thr | Gly | D-Cys | Lys |
| — | Gly | D-Cys | Cys | Glu | Phe | Cys | Cys | Thr | Pro | Ala | Cys | Thr | Gly | D-Cys | Tyr |
| — | Gly | D-Cys | Cys | Glu | Phe | D-Cys | Cys | Asn | Pro | Ala | Cys | Thr | Gly | Cys | — |
| — | Gly | D-Cys | Cys | Glu | Phe | D-Cys | Cys | Asn | Pro | Ala | Cys | Thr | Gly | Cys | Lys |
| — | Gly | D-Cys | Cys | Glu | Phe | D-Cys | Cys | Asn | Pro | Ala | Cys | Thr | Gly | Cys | Tyr |
| — | Gly | D-Cys | Cys | Glu | Phe | D-Cys | Cys | Asn | Pro | Ala | Cys | Thr | Gly | D-Cys | — |
| — | Gly | D-Cys | Cys | Glu | Phe | D-Cys | Cys | Asn | Pro | Ala | Cys | Thr | Gly | D-Cys | Lys |
| — | Gly | D-Cys | Cys | Glu | Phe | D-Cys | Cys | Asn | Pro | Ala | Cys | Thr | Gly | D-Cys | Tyr |
| — | Gly | D-Cys | Cys | Glu | Phe | D-Cys | Cys | Thr | Pro | Ala | Cys | Thr | Gly | Cys | — |
| — | Gly | D-Cys | Cys | Glu | Phe | D-Cys | Cys | Thr | Pro | Ala | Cys | Thr | Gly | Cys | Lys |
| — | Gly | D-Cys | Cys | Glu | Phe | D-Cys | Cys | Thr | Pro | Ala | Cys | Thr | Gly | Cys | Tyr |
| — | Gly | D-Cys | Cys | Glu | Phe | D-Cys | Cys | Thr | Pro | Ala | Cys | Thr | Gly | D-Cys | — |
| — | Gly | D-Cys | Cys | Glu | Phe | D-Cys | Cys | Thr | Pro | Ala | Cys | Thr | Gly | D-Cys | Lys |
| — | Gly | D-Cys | Cys | Glu | Phe | D-Cys | Cys | Thr | Pro | Ala | Cys | Thr | Gly | D-Cys | Tyr |
| — | Gly | D-Cys | Cys | Glu | Trp | Cys | Cys | Asn | Pro | Ala | Cys | Thr | Gly | Cys | — |
| — | Gly | D-Cys | Cys | Glu | Trp | Cys | Cys | Asn | Pro | Ala | Cys | Thr | Gly | Cys | Lys |
| — | Gly | D-Cys | Cys | Glu | Trp | Cys | Cys | Asn | Pro | Ala | Cys | Thr | Gly | Cys | Tyr |

FIG. 3A-14

| | | | | | | | | | | | | | | |
|---|---|---|---|---|---|---|---|---|---|---|---|---|---|---|
| — | Gly | D-Cys | Cys | Glu | Trp | Cys | Cys | Asn | Pro | Ala | Cys | Thr | Gly | D-Cys | — |
| — | Gly | D-Cys | Cys | Glu | Trp | Cys | Cys | Asn | Pro | Ala | Cys | Thr | Gly | D-Cys | Lys |
| — | Gly | D-Cys | Cys | Glu | Trp | Cys | Cys | Asn | Pro | Ala | Cys | Thr | Gly | D-Cys | Tyr |
| — | Gly | D-Cys | Cys | Glu | Trp | Cys | Cys | Thr | Pro | Ala | Cys | Thr | Gly | Cys | — |
| — | Gly | D-Cys | Cys | Glu | Trp | Cys | Cys | Thr | Pro | Ala | Cys | Thr | Gly | Cys | Lys |
| — | Gly | D-Cys | Cys | Glu | Trp | Cys | Cys | Thr | Pro | Ala | Cys | Thr | Gly | Cys | Tyr |
| — | Gly | D-Cys | Cys | Glu | Trp | Cys | Cys | Thr | Pro | Ala | Cys | Thr | Gly | D-Cys | — |
| — | Gly | D-Cys | Cys | Glu | Trp | Cys | Cys | Thr | Pro | Ala | Cys | Thr | Gly | D-Cys | Lys |
| — | Gly | D-Cys | Cys | Glu | Trp | Cys | Cys | Thr | Pro | Ala | Cys | Thr | Gly | D-Cys | Tyr |
| — | Gly | D-Cys | Cys | Glu | Trp | D-Cys | Cys | Asn | Pro | Ala | Cys | Thr | Gly | Cys | — |
| — | Gly | D-Cys | Cys | Glu | Trp | D-Cys | Cys | Asn | Pro | Ala | Cys | Thr | Gly | Cys | Lys |
| — | Gly | D-Cys | Cys | Glu | Trp | D-Cys | Cys | Asn | Pro | Ala | Cys | Thr | Gly | Cys | Tyr |
| — | Gly | D-Cys | Cys | Glu | Trp | D-Cys | Cys | Asn | Pro | Ala | Cys | Thr | Gly | D-Cys | — |
| — | Gly | D-Cys | Cys | Glu | Trp | D-Cys | Cys | Asn | Pro | Ala | Cys | Thr | Gly | D-Cys | Lys |
| — | Gly | D-Cys | Cys | Glu | Trp | D-Cys | Cys | Asn | Pro | Ala | Cys | Thr | Gly | D-Cys | Tyr |
| — | Gly | D-Cys | Cys | Glu | Trp | D-Cys | Cys | Thr | Pro | Ala | Cys | Thr | Gly | Cys | — |
| — | Gly | D-Cys | Cys | Glu | Trp | D-Cys | Cys | Thr | Pro | Ala | Cys | Thr | Gly | Cys | Lys |
| — | Gly | D-Cys | Cys | Glu | Trp | D-Cys | Cys | Thr | Pro | Ala | Cys | Thr | Gly | Cys | Tyr |
| — | Gly | D-Cys | Cys | Glu | Trp | D-Cys | Cys | Thr | Pro | Ala | Cys | Thr | Gly | D-Cys | — |
| — | Gly | D-Cys | Cys | Glu | Trp | D-Cys | Cys | Thr | Pro | Ala | Cys | Thr | Gly | D-Cys | Lys |
| — | Gly | D-Cys | Cys | Glu | Trp | D-Cys | Cys | Thr | Pro | Ala | Cys | Thr | Gly | D-Cys | Tyr |
| — | Lys | Cys | Cys | Glu | Val | Cys | Cys | Asn | Pro | Ala | Cys | Thr | Gly | Cys | — |
| — | Lys | Cys | Cys | Glu | Val | Cys | Cys | Asn | Pro | Ala | Cys | Thr | Gly | Cys | Lys |
| — | Lys | Cys | Cys | Glu | Val | Cys | Cys | Asn | Pro | Ala | Cys | Thr | Gly | Cys | Tyr |
| — | Lys | Cys | Cys | Glu | Val | Cys | Cys | Asn | Pro | Ala | Cys | Thr | Gly | D-Cys | — |
| — | Lys | Cys | Cys | Glu | Val | Cys | Cys | Asn | Pro | Ala | Cys | Thr | Gly | D-Cys | Lys |
| — | Lys | Cys | Cys | Glu | Val | Cys | Cys | Asn | Pro | Ala | Cys | Thr | Gly | D-Cys | Tyr |
| — | Lys | Cys | Cys | Glu | Val | Cys | Cys | Thr | Pro | Ala | Cys | Thr | Gly | Cys | — |
| — | Lys | Cys | Cys | Glu | Val | Cys | Cys | Thr | Pro | Ala | Cys | Thr | Gly | Cys | Lys |
| — | Lys | Cys | Cys | Glu | Val | Cys | Cys | Thr | Pro | Ala | Cys | Thr | Gly | Cys | Tyr |
| — | Lys | Cys | Cys | Glu | Val | Cys | Cys | Thr | Pro | Ala | Cys | Thr | Gly | D-Cys | — |
| — | Lys | Cys | Cys | Glu | Val | Cys | Cys | Thr | Pro | Ala | Cys | Thr | Gly | D-Cys | Lys |
| — | Lys | Cys | Cys | Glu | Val | Cys | Cys | Thr | Pro | Ala | Cys | Thr | Gly | D-Cys | Tyr |
| — | Lys | Cys | Cys | Glu | Val | D-Cys | Cys | Asn | Pro | Ala | Cys | Thr | Gly | Cys | — |
| — | Lys | Cys | Cys | Glu | Val | D-Cys | Cys | Asn | Pro | Ala | Cys | Thr | Gly | Cys | Lys |
| — | Lys | Cys | Cys | Glu | Val | D-Cys | Cys | Asn | Pro | Ala | Cys | Thr | Gly | Cys | Tyr |
| — | Lys | Cys | Cys | Glu | Val | D-Cys | Cys | Asn | Pro | Ala | Cys | Thr | Gly | D-Cys | — |
| — | Lys | Cys | Cys | Glu | Val | D-Cys | Cys | Asn | Pro | Ala | Cys | Thr | Gly | D-Cys | Lys |
| — | Lys | Cys | Cys | Glu | Val | D-Cys | Cys | Asn | Pro | Ala | Cys | Thr | Gly | D-Cys | Tyr |
| — | Lys | Cys | Cys | Glu | Val | D-Cys | Cys | Thr | Pro | Ala | Cys | Thr | Gly | Cys | — |
| — | Lys | Cys | Cys | Glu | Val | D-Cys | Cys | Thr | Pro | Ala | Cys | Thr | Gly | Cys | Lys |
| — | Lys | Cys | Cys | Glu | Val | D-Cys | Cys | Thr | Pro | Ala | Cys | Thr | Gly | Cys | Tyr |
| — | Lys | Cys | Cys | Glu | Val | D-Cys | Cys | Thr | Pro | Ala | Cys | Thr | Gly | D-Cys | — |
| — | Lys | Cys | Cys | Glu | Val | D-Cys | Cys | Thr | Pro | Ala | Cys | Thr | Gly | D-Cys | Lys |
| — | Lys | Cys | Cys | Glu | Val | D-Cys | Cys | Thr | Pro | Ala | Cys | Thr | Gly | D-Cys | Tyr |
| — | Lys | Cys | Cys | Glu | Ile | Cys | Cys | Asn | Pro | Ala | Cys | Thr | Gly | Cys | — |
| — | Lys | Cys | Cys | Glu | Ile | Cys | Cys | Asn | Pro | Ala | Cys | Thr | Gly | Cys | Lys |
| — | Lys | Cys | Cys | Glu | Ile | Cys | Cys | Asn | Pro | Ala | Cys | Thr | Gly | Cys | Tyr |
| — | Lys | Cys | Cys | Glu | Ile | Cys | Cys | Asn | Pro | Ala | Cys | Thr | Gly | D-Cys | — |
| — | Lys | Cys | Cys | Glu | Ile | Cys | Cys | Asn | Pro | Ala | Cys | Thr | Gly | D-Cys | Lys |
| — | Lys | Cys | Cys | Glu | Ile | Cys | Cys | Asn | Pro | Ala | Cys | Thr | Gly | D-Cys | Tyr |
| — | Lys | Cys | Cys | Glu | Ile | Cys | Cys | Thr | Pro | Ala | Cys | Thr | Gly | Cys | — |
| — | Lys | Cys | Cys | Glu | Ile | Cys | Cys | Thr | Pro | Ala | Cys | Thr | Gly | Cys | Lys |
| — | Lys | Cys | Cys | Glu | Ile | Cys | Cys | Thr | Pro | Ala | Cys | Thr | Gly | Cys | Tyr |
| — | Lys | Cys | Cys | Glu | Ile | Cys | Cys | Thr | Pro | Ala | Cys | Thr | Gly | D-Cys | — |
| — | Lys | Cys | Cys | Glu | Ile | Cys | Cys | Thr | Pro | Ala | Cys | Thr | Gly | D-Cys | Lys |
| — | Lys | Cys | Cys | Glu | Ile | Cys | Cys | Thr | Pro | Ala | Cys | Thr | Gly | D-Cys | Tyr |
| — | Lys | Cys | Cys | Glu | Ile | D-Cys | Cys | Asn | Pro | Ala | Cys | Thr | Gly | Cys | — |
| — | Lys | Cys | Cys | Glu | Ile | D-Cys | Cys | Asn | Pro | Ala | Cys | Thr | Gly | Cys | Lys |
| — | Lys | Cys | Cys | Glu | Ile | D-Cys | Cys | Asn | Pro | Ala | Cys | Thr | Gly | Cys | Tyr |

FIG. 3A-15

| | | | | | | | | | | | | | | |
|---|---|---|---|---|---|---|---|---|---|---|---|---|---|---|
| — | Lys | Cys | Cys | Glu | Ile | D-Cys | Cys | Asn | Pro | Ala | Cys | Thr | Gly | D-Cys | — |
| — | Lys | Cys | Cys | Glu | Ile | D-Cys | Cys | Asn | Pro | Ala | Cys | Thr | Gly | D-Cys | Lys |
| — | Lys | Cys | Cys | Glu | Ile | D-Cys | Cys | Asn | Pro | Ala | Cys | Thr | Gly | D-Cys | Tyr |
| — | Lys | Cys | Cys | Glu | Ile | D-Cys | Cys | Thr | Pro | Ala | Cys | Thr | Gly | Cys | — |
| — | Lys | Cys | Cys | Glu | Ile | D-Cys | Cys | Thr | Pro | Ala | Cys | Thr | Gly | Cys | Lys |
| — | Lys | Cys | Cys | Glu | Ile | D-Cys | Cys | Thr | Pro | Ala | Cys | Thr | Gly | Cys | Tyr |
| — | Lys | Cys | Cys | Glu | Ile | D-Cys | Cys | Thr | Pro | Ala | Cys | Thr | Gly | D-Cys | — |
| — | Lys | Cys | Cys | Glu | Ile | D-Cys | Cys | Thr | Pro | Ala | Cys | Thr | Gly | D-Cys | Lys |
| — | Lys | Cys | Cys | Glu | Ile | D-Cys | Cys | Thr | Pro | Ala | Cys | Thr | Gly | D-Cys | Tyr |
| — | Lys | Cys | Cys | Glu | Leu | Cys | Cys | Asn | Pro | Ala | Cys | Thr | Gly | Cys | — |
| — | Lys | Cys | Cys | Glu | Leu | Cys | Cys | Asn | Pro | Ala | Cys | Thr | Gly | Cys | Lys |
| — | Lys | Cys | Cys | Glu | Leu | Cys | Cys | Asn | Pro | Ala | Cys | Thr | Gly | Cys | Tyr |
| — | Lys | Cys | Cys | Glu | Leu | Cys | Cys | Asn | Pro | Ala | Cys | Thr | Gly | D-Cys | — |
| — | Lys | Cys | Cys | Glu | Leu | Cys | Cys | Asn | Pro | Ala | Cys | Thr | Gly | D-Cys | Lys |
| — | Lys | Cys | Cys | Glu | Leu | Cys | Cys | Asn | Pro | Ala | Cys | Thr | Gly | D-Cys | Tyr |
| — | Lys | Cys | Cys | Glu | Leu | Cys | Cys | Thr | Pro | Ala | Cys | Thr | Gly | Cys | — |
| — | Lys | Cys | Cys | Glu | Leu | Cys | Cys | Thr | Pro | Ala | Cys | Thr | Gly | Cys | Lys |
| — | Lys | Cys | Cys | Glu | Leu | Cys | Cys | Thr | Pro | Ala | Cys | Thr | Gly | Cys | Tyr |
| — | Lys | Cys | Cys | Glu | Leu | Cys | Cys | Thr | Pro | Ala | Cys | Thr | Gly | D-Cys | — |
| — | Lys | Cys | Cys | Glu | Leu | Cys | Cys | Thr | Pro | Ala | Cys | Thr | Gly | D-Cys | Lys |
| — | Lys | Cys | Cys | Glu | Leu | Cys | Cys | Thr | Pro | Ala | Cys | Thr | Gly | D-Cys | Tyr |
| — | Lys | Cys | Cys | Glu | Leu | D-Cys | Cys | Asn | Pro | Ala | Cys | Thr | Gly | Cys | — |
| — | Lys | Cys | Cys | Glu | Leu | D-Cys | Cys | Asn | Pro | Ala | Cys | Thr | Gly | Cys | Lys |
| — | Lys | Cys | Cys | Glu | Leu | D-Cys | Cys | Asn | Pro | Ala | Cys | Thr | Gly | Cys | Tyr |
| — | Lys | Cys | Cys | Glu | Leu | D-Cys | Cys | Asn | Pro | Ala | Cys | Thr | Gly | D-Cys | — |
| — | Lys | Cys | Cys | Glu | Leu | D-Cys | Cys | Asn | Pro | Ala | Cys | Thr | Gly | D-Cys | Lys |
| — | Lys | Cys | Cys | Glu | Leu | D-Cys | Cys | Asn | Pro | Ala | Cys | Thr | Gly | D-Cys | Tyr |
| — | Lys | Cys | Cys | Glu | Leu | D-Cys | Cys | Thr | Pro | Ala | Cys | Thr | Gly | Cys | — |
| — | Lys | Cys | Cys | Glu | Leu | D-Cys | Cys | Thr | Pro | Ala | Cys | Thr | Gly | Cys | Lys |
| — | Lys | Cys | Cys | Glu | Leu | D-Cys | Cys | Thr | Pro | Ala | Cys | Thr | Gly | Cys | Tyr |
| — | Lys | Cys | Cys | Glu | Leu | D-Cys | Cys | Thr | Pro | Ala | Cys | Thr | Gly | D-Cys | — |
| — | Lys | Cys | Cys | Glu | Leu | D-Cys | Cys | Thr | Pro | Ala | Cys | Thr | Gly | D-Cys | Lys |
| — | Lys | Cys | Cys | Glu | Leu | D-Cys | Cys | Thr | Pro | Ala | Cys | Thr | Gly | D-Cys | Tyr |
| — | Lys | Cys | Cys | Glu | Tyr | Cys | Cys | Asn | Pro | Ala | Cys | Thr | Gly | Cys | — |
| — | Lys | Cys | Cys | Glu | Tyr | Cys | Cys | Asn | Pro | Ala | Cys | Thr | Gly | Cys | Lys |
| — | Lys | Cys | Cys | Glu | Tyr | Cys | Cys | Asn | Pro | Ala | Cys | Thr | Gly | Cys | Tyr |
| — | Lys | Cys | Cys | Glu | Tyr | Cys | Cys | Asn | Pro | Ala | Cys | Thr | Gly | D-Cys | — |
| — | Lys | Cys | Cys | Glu | Tyr | Cys | Cys | Asn | Pro | Ala | Cys | Thr | Gly | D-Cys | Lys |
| — | Lys | Cys | Cys | Glu | Tyr | Cys | Cys | Asn | Pro | Ala | Cys | Thr | Gly | D-Cys | Tyr |
| — | Lys | Cys | Cys | Glu | Tyr | Cys | Cys | Thr | Pro | Ala | Cys | Thr | Gly | Cys | — |
| — | Lys | Cys | Cys | Glu | Tyr | Cys | Cys | Thr | Pro | Ala | Cys | Thr | Gly | Cys | Lys |
| — | Lys | Cys | Cys | Glu | Tyr | Cys | Cys | Thr | Pro | Ala | Cys | Thr | Gly | Cys | Tyr |
| — | Lys | Cys | Cys | Glu | Tyr | Cys | Cys | Thr | Pro | Ala | Cys | Thr | Gly | D-Cys | — |
| — | Lys | Cys | Cys | Glu | Tyr | Cys | Cys | Thr | Pro | Ala | Cys | Thr | Gly | D-Cys | Lys |
| — | Lys | Cys | Cys | Glu | Tyr | Cys | Cys | Thr | Pro | Ala | Cys | Thr | Gly | D-Cys | Tyr |
| — | Lys | Cys | Cys | Glu | Tyr | D-Cys | Cys | Asn | Pro | Ala | Cys | Thr | Gly | Cys | — |
| — | Lys | Cys | Cys | Glu | Tyr | D-Cys | Cys | Asn | Pro | Ala | Cys | Thr | Gly | Cys | Lys |
| — | Lys | Cys | Cys | Glu | Tyr | D-Cys | Cys | Asn | Pro | Ala | Cys | Thr | Gly | Cys | Tyr |
| — | Lys | Cys | Cys | Glu | Tyr | D-Cys | Cys | Asn | Pro | Ala | Cys | Thr | Gly | D-Cys | — |
| — | Lys | Cys | Cys | Glu | Tyr | D-Cys | Cys | Asn | Pro | Ala | Cys | Thr | Gly | D-Cys | Lys |
| — | Lys | Cys | Cys | Glu | Tyr | D-Cys | Cys | Asn | Pro | Ala | Cys | Thr | Gly | D-Cys | Tyr |
| — | Lys | Cys | Cys | Glu | Tyr | D-Cys | Cys | Thr | Pro | Ala | Cys | Thr | Gly | Cys | — |
| — | Lys | Cys | Cys | Glu | Tyr | D-Cys | Cys | Thr | Pro | Ala | Cys | Thr | Gly | Cys | Lys |
| — | Lys | Cys | Cys | Glu | Tyr | D-Cys | Cys | Thr | Pro | Ala | Cys | Thr | Gly | Cys | Tyr |
| — | Lys | Cys | Cys | Glu | Tyr | D-Cys | Cys | Thr | Pro | Ala | Cys | Thr | Gly | D-Cys | — |
| — | Lys | Cys | Cys | Glu | Tyr | D-Cys | Cys | Thr | Pro | Ala | Cys | Thr | Gly | D-Cys | Lys |
| — | Lys | Cys | Cys | Glu | Tyr | D-Cys | Cys | Thr | Pro | Ala | Cys | Thr | Gly | D-Cys | Tyr |
| — | Lys | Cys | Cys | Glu | Phe | Cys | Cys | Asn | Pro | Ala | Cys | Thr | Gly | Cys | — |
| — | Lys | Cys | Cys | Glu | Phe | Cys | Cys | Asn | Pro | Ala | Cys | Thr | Gly | Cys | Lys |
| — | Lys | Cys | Cys | Glu | Phe | Cys | Cys | Asn | Pro | Ala | Cys | Thr | Gly | Cys | Tyr |

FIG. 3A-16

| | | | | | | | | | | | | | | | |
|---|---|---|---|---|---|---|---|---|---|---|---|---|---|---|---|
| — | Lys | Cys | Cys | Glu | Phe | Cys | Cys | Asn | Pro | Ala | Cys | Thr | Gly | D-Cys | — |
| — | Lys | Cys | Cys | Glu | Phe | Cys | Cys | Asn | Pro | Ala | Cys | Thr | Gly | D-Cys | Lys |
| — | Lys | Cys | Cys | Glu | Phe | Cys | Cys | Asn | Pro | Ala | Cys | Thr | Gly | D-Cys | Tyr |
| — | Lys | Cys | Cys | Glu | Phe | Cys | Cys | Thr | Pro | Ala | Cys | Thr | Gly | Cys | — |
| — | Lys | Cys | Cys | Glu | Phe | Cys | Cys | Thr | Pro | Ala | Cys | Thr | Gly | Cys | Lys |
| — | Lys | Cys | Cys | Glu | Phe | Cys | Cys | Thr | Pro | Ala | Cys | Thr | Gly | Cys | Tyr |
| — | Lys | Cys | Cys | Glu | Phe | Cys | Cys | Thr | Pro | Ala | Cys | Thr | Gly | D-Cys | — |
| — | Lys | Cys | Cys | Glu | Phe | Cys | Cys | Thr | Pro | Ala | Cys | Thr | Gly | D-Cys | Lys |
| — | Lys | Cys | Cys | Glu | Phe | Cys | Cys | Thr | Pro | Ala | Cys | Thr | Gly | D-Cys | Tyr |
| — | Lys | Cys | Cys | Glu | Phe | D-Cys | Cys | Asn | Pro | Ala | Cys | Thr | Gly | Cys | — |
| — | Lys | Cys | Cys | Glu | Phe | D-Cys | Cys | Asn | Pro | Ala | Cys | Thr | Gly | Cys | Lys |
| — | Lys | Cys | Cys | Glu | Phe | D-Cys | Cys | Asn | Pro | Ala | Cys | Thr | Gly | Cys | Tyr |
| — | Lys | Cys | Cys | Glu | Phe | D-Cys | Cys | Asn | Pro | Ala | Cys | Thr | Gly | D-Cys | — |
| — | Lys | Cys | Cys | Glu | Phe | D-Cys | Cys | Asn | Pro | Ala | Cys | Thr | Gly | D-Cys | Lys |
| — | Lys | Cys | Cys | Glu | Phe | D-Cys | Cys | Asn | Pro | Ala | Cys | Thr | Gly | D-Cys | Tyr |
| — | Lys | Cys | Cys | Glu | Phe | D-Cys | Cys | Thr | Pro | Ala | Cys | Thr | Gly | Cys | — |
| — | Lys | Cys | Cys | Glu | Phe | D-Cys | Cys | Thr | Pro | Ala | Cys | Thr | Gly | Cys | Lys |
| — | Lys | Cys | Cys | Glu | Phe | D-Cys | Cys | Thr | Pro | Ala | Cys | Thr | Gly | Cys | Tyr |
| — | Lys | Cys | Cys | Glu | Trp | Cys | Cys | Asn | Pro | Ala | Cys | Thr | Gly | Cys | — |
| — | Lys | Cys | Cys | Glu | Trp | Cys | Cys | Asn | Pro | Ala | Cys | Thr | Gly | Cys | Lys |
| — | Lys | Cys | Cys | Glu | Trp | Cys | Cys | Asn | Pro | Ala | Cys | Thr | Gly | Cys | Tyr |
| — | Lys | Cys | Cys | Glu | Trp | Cys | Cys | Asn | Pro | Ala | Cys | Thr | Gly | D-Cys | — |
| — | Lys | Cys | Cys | Glu | Trp | Cys | Cys | Asn | Pro | Ala | Cys | Thr | Gly | D-Cys | Lys |
| — | Lys | Cys | Cys | Glu | Trp | Cys | Cys | Asn | Pro | Ala | Cys | Thr | Gly | D-Cys | Tyr |
| — | Lys | Cys | Cys | Glu | Trp | Cys | Cys | Thr | Pro | Ala | Cys | Thr | Gly | Cys | — |
| — | Lys | Cys | Cys | Glu | Trp | Cys | Cys | Thr | Pro | Ala | Cys | Thr | Gly | Cys | Lys |
| — | Lys | Cys | Cys | Glu | Trp | Cys | Cys | Thr | Pro | Ala | Cys | Thr | Gly | Cys | Tyr |
| — | Lys | Cys | Cys | Glu | Trp | Cys | Cys | Thr | Pro | Ala | Cys | Thr | Gly | D-Cys | — |
| — | Lys | Cys | Cys | Glu | Trp | Cys | Cys | Thr | Pro | Ala | Cys | Thr | Gly | D-Cys | Lys |
| — | Lys | Cys | Cys | Glu | Trp | Cys | Cys | Thr | Pro | Ala | Cys | Thr | Gly | D-Cys | Tyr |
| — | Lys | Cys | Cys | Glu | Trp | D-Cys | Cys | Asn | Pro | Ala | Cys | Thr | Gly | Cys | — |
| — | Lys | Cys | Cys | Glu | Trp | D-Cys | Cys | Asn | Pro | Ala | Cys | Thr | Gly | Cys | Lys |
| — | Lys | Cys | Cys | Glu | Trp | D-Cys | Cys | Asn | Pro | Ala | Cys | Thr | Gly | Cys | Tyr |
| — | Lys | Cys | Cys | Glu | Trp | D-Cys | Cys | Asn | Pro | Ala | Cys | Thr | Gly | D-Cys | — |
| — | Lys | Cys | Cys | Glu | Trp | D-Cys | Cys | Asn | Pro | Ala | Cys | Thr | Gly | D-Cys | Lys |
| — | Lys | Cys | Cys | Glu | Trp | D-Cys | Cys | Asn | Pro | Ala | Cys | Thr | Gly | D-Cys | Tyr |
| — | Lys | Cys | Cys | Glu | Trp | D-Cys | Cys | Thr | Pro | Ala | Cys | Thr | Gly | Cys | — |
| — | Lys | Cys | Cys | Glu | Trp | D-Cys | Cys | Thr | Pro | Ala | Cys | Thr | Gly | Cys | Lys |
| — | Lys | Cys | Cys | Glu | Trp | D-Cys | Cys | Thr | Pro | Ala | Cys | Thr | Gly | Cys | Tyr |
| — | Lys | Cys | Cys | Glu | Trp | D-Cys | Cys | Thr | Pro | Ala | Cys | Thr | Gly | D-Cys | — |
| — | Lys | Cys | Cys | Glu | Trp | D-Cys | Cys | Thr | Pro | Ala | Cys | Thr | Gly | D-Cys | Lys |
| — | Lys | Cys | Cys | Glu | Trp | D-Cys | Cys | Thr | Pro | Ala | Cys | Thr | Gly | D-Cys | Tyr |
| — | Lys | D-Cys | Cys | Glu | Val | Cys | Cys | Asn | Pro | Ala | Cys | Thr | Gly | Cys | — |
| — | Lys | D-Cys | Cys | Glu | Val | Cys | Cys | Asn | Pro | Ala | Cys | Thr | Gly | Cys | Lys |
| — | Lys | D-Cys | Cys | Glu | Val | Cys | Cys | Asn | Pro | Ala | Cys | Thr | Gly | Cys | Tyr |
| — | Lys | D-Cys | Cys | Glu | Val | Cys | Cys | Asn | Pro | Ala | Cys | Thr | Gly | D-Cys | — |
| — | Lys | D-Cys | Cys | Glu | Val | Cys | Cys | Asn | Pro | Ala | Cys | Thr | Gly | D-Cys | Lys |
| — | Lys | D-Cys | Cys | Glu | Val | Cys | Cys | Asn | Pro | Ala | Cys | Thr | Gly | D-Cys | Tyr |
| — | Lys | D-Cys | Cys | Glu | Val | Cys | Cys | Thr | Pro | Ala | Cys | Thr | Gly | Cys | — |
| — | Lys | D-Cys | Cys | Glu | Val | Cys | Cys | Thr | Pro | Ala | Cys | Thr | Gly | Cys | Lys |
| — | Lys | D-Cys | Cys | Glu | Val | Cys | Cys | Thr | Pro | Ala | Cys | Thr | Gly | Cys | Tyr |
| — | Lys | D-Cys | Cys | Glu | Val | Cys | Cys | Thr | Pro | Ala | Cys | Thr | Gly | D-Cys | — |
| — | Lys | D-Cys | Cys | Glu | Val | Cys | Cys | Thr | Pro | Ala | Cys | Thr | Gly | D-Cys | Lys |
| — | Lys | D-Cys | Cys | Glu | Val | Cys | Cys | Thr | Pro | Ala | Cys | Thr | Gly | D-Cys | Tyr |
| — | Lys | D-Cys | Cys | Glu | Val | D-Cys | Cys | Asn | Pro | Ala | Cys | Thr | Gly | Cys | — |
| — | Lys | D-Cys | Cys | Glu | Val | D-Cys | Cys | Asn | Pro | Ala | Cys | Thr | Gly | Cys | Lys |
| — | Lys | D-Cys | Cys | Glu | Val | D-Cys | Cys | Asn | Pro | Ala | Cys | Thr | Gly | Cys | Tyr |

FIG. 3A-17

| | | | | | | | | | | | | | | |
|---|---|---|---|---|---|---|---|---|---|---|---|---|---|---|
| — | Lys | D-Cys | Cys | Glu | Val | D-Cys | Cys | Asn | Pro | Ala | Cys | Thr | Gly | D-Cys | — |
| — | Lys | D-Cys | Cys | Glu | Val | D-Cys | Cys | Asn | Pro | Ala | Cys | Thr | Gly | D-Cys | Lys |
| — | Lys | D-Cys | Cys | Glu | Val | D-Cys | Cys | Asn | Pro | Ala | Cys | Thr | Gly | D-Cys | Tyr |
| — | Lys | D-Cys | Cys | Glu | Val | D-Cys | Cys | Thr | Pro | Ala | Cys | Thr | Gly | Cys | — |
| — | Lys | D-Cys | Cys | Glu | Val | D-Cys | Cys | Thr | Pro | Ala | Cys | Thr | Gly | Cys | Lys |
| — | Lys | D-Cys | Cys | Glu | Val | D-Cys | Cys | Thr | Pro | Ala | Cys | Thr | Gly | Cys | Tyr |
| — | Lys | D-Cys | Cys | Glu | Val | D-Cys | Cys | Thr | Pro | Ala | Cys | Thr | Gly | D-Cys | — |
| — | Lys | D-Cys | Cys | Glu | Val | D-Cys | Cys | Thr | Pro | Ala | Cys | Thr | Gly | D-Cys | Lys |
| — | Lys | D-Cys | Cys | Glu | Val | D-Cys | Cys | Thr | Pro | Ala | Cys | Thr | Gly | D-Cys | Tyr |
| — | Lys | D-Cys | Cys | Glu | Ile | Cys | Cys | Asn | Pro | Ala | Cys | Thr | Gly | Cys | — |
| — | Lys | D-Cys | Cys | Glu | Ile | Cys | Cys | Asn | Pro | Ala | Cys | Thr | Gly | Cys | Lys |
| — | Lys | D-Cys | Cys | Glu | Ile | Cys | Cys | Asn | Pro | Ala | Cys | Thr | Gly | Cys | Tyr |
| — | Lys | D-Cys | Cys | Glu | Ile | Cys | Cys | Asn | Pro | Ala | Cys | Thr | Gly | D-Cys | — |
| — | Lys | D-Cys | Cys | Glu | Ile | Cys | Cys | Asn | Pro | Ala | Cys | Thr | Gly | D-Cys | Lys |
| — | Lys | D-Cys | Cys | Glu | Ile | Cys | Cys | Asn | Pro | Ala | Cys | Thr | Gly | D-Cys | Tyr |
| — | Lys | D-Cys | Cys | Glu | Ile | Cys | Cys | Thr | Pro | Ala | Cys | Thr | Gly | Cys | — |
| — | Lys | D-Cys | Cys | Glu | Ile | Cys | Cys | Thr | Pro | Ala | Cys | Thr | Gly | Cys | Lys |
| — | Lys | D-Cys | Cys | Glu | Ile | Cys | Cys | Thr | Pro | Ala | Cys | Thr | Gly | Cys | Tyr |
| — | Lys | D-Cys | Cys | Glu | Ile | Cys | Cys | Thr | Pro | Ala | Cys | Thr | Gly | D-Cys | — |
| — | Lys | D-Cys | Cys | Glu | Ile | Cys | Cys | Thr | Pro | Ala | Cys | Thr | Gly | D-Cys | Lys |
| — | Lys | D-Cys | Cys | Glu | Ile | Cys | Cys | Thr | Pro | Ala | Cys | Thr | Gly | D-Cys | Tyr |
| — | Lys | D-Cys | Cys | Glu | Ile | D-Cys | Cys | Asn | Pro | Ala | Cys | Thr | Gly | Cys | — |
| — | Lys | D-Cys | Cys | Glu | Ile | D-Cys | Cys | Asn | Pro | Ala | Cys | Thr | Gly | Cys | Lys |
| — | Lys | D-Cys | Cys | Glu | Ile | D-Cys | Cys | Asn | Pro | Ala | Cys | Thr | Gly | Cys | Tyr |
| — | Lys | D-Cys | Cys | Glu | Ile | D-Cys | Cys | Asn | Pro | Ala | Cys | Thr | Gly | D-Cys | — |
| — | Lys | D-Cys | Cys | Glu | Ile | D-Cys | Cys | Asn | Pro | Ala | Cys | Thr | Gly | D-Cys | Lys |
| — | Lys | D-Cys | Cys | Glu | Ile | D-Cys | Cys | Asn | Pro | Ala | Cys | Thr | Gly | D-Cys | Tyr |
| — | Lys | D-Cys | Cys | Glu | Ile | D-Cys | Cys | Thr | Pro | Ala | Cys | Thr | Gly | Cys | — |
| — | Lys | D-Cys | Cys | Glu | Ile | D-Cys | Cys | Thr | Pro | Ala | Cys | Thr | Gly | Cys | Lys |
| — | Lys | D-Cys | Cys | Glu | Ile | D-Cys | Cys | Thr | Pro | Ala | Cys | Thr | Gly | Cys | Tyr |
| — | Lys | D-Cys | Cys | Glu | Ile | D-Cys | Cys | Thr | Pro | Ala | Cys | Thr | Gly | D-Cys | — |
| — | Lys | D-Cys | Cys | Glu | Ile | D-Cys | Cys | Thr | Pro | Ala | Cys | Thr | Gly | D-Cys | Lys |
| — | Lys | D-Cys | Cys | Glu | Ile | D-Cys | Cys | Thr | Pro | Ala | Cys | Thr | Gly | D-Cys | Tyr |
| — | Lys | D-Cys | Cys | Glu | Leu | Cys | Cys | Asn | Pro | Ala | Cys | Thr | Gly | Cys | — |
| — | Lys | D-Cys | Cys | Glu | Leu | Cys | Cys | Asn | Pro | Ala | Cys | Thr | Gly | Cys | Lys |
| — | Lys | D-Cys | Cys | Glu | Leu | Cys | Cys | Asn | Pro | Ala | Cys | Thr | Gly | Cys | Tyr |
| — | Lys | D-Cys | Cys | Glu | Leu | Cys | Cys | Asn | Pro | Ala | Cys | Thr | Gly | D-Cys | — |
| — | Lys | D-Cys | Cys | Glu | Leu | Cys | Cys | Asn | Pro | Ala | Cys | Thr | Gly | D-Cys | Lys |
| — | Lys | D-Cys | Cys | Glu | Leu | Cys | Cys | Asn | Pro | Ala | Cys | Thr | Gly | D-Cys | Tyr |
| — | Lys | D-Cys | Cys | Glu | Leu | Cys | Cys | Thr | Pro | Ala | Cys | Thr | Gly | Cys | — |
| — | Lys | D-Cys | Cys | Glu | Leu | Cys | Cys | Thr | Pro | Ala | Cys | Thr | Gly | Cys | Lys |
| — | Lys | D-Cys | Cys | Glu | Leu | Cys | Cys | Thr | Pro | Ala | Cys | Thr | Gly | Cys | Tyr |
| — | Lys | D-Cys | Cys | Glu | Leu | Cys | Cys | Thr | Pro | Ala | Cys | Thr | Gly | D-Cys | — |
| — | Lys | D-Cys | Cys | Glu | Leu | Cys | Cys | Thr | Pro | Ala | Cys | Thr | Gly | D-Cys | Lys |
| — | Lys | D-Cys | Cys | Glu | Leu | Cys | Cys | Thr | Pro | Ala | Cys | Thr | Gly | D-Cys | Tyr |
| — | Lys | D-Cys | Cys | Glu | Leu | D-Cys | Cys | Asn | Pro | Ala | Cys | Thr | Gly | Cys | — |
| — | Lys | D-Cys | Cys | Glu | Leu | D-Cys | Cys | Asn | Pro | Ala | Cys | Thr | Gly | Cys | Lys |
| — | Lys | D-Cys | Cys | Glu | Leu | D-Cys | Cys | Asn | Pro | Ala | Cys | Thr | Gly | Cys | Tyr |
| — | Lys | D-Cys | Cys | Glu | Leu | D-Cys | Cys | Asn | Pro | Ala | Cys | Thr | Gly | D-Cys | — |
| — | Lys | D-Cys | Cys | Glu | Leu | D-Cys | Cys | Asn | Pro | Ala | Cys | Thr | Gly | D-Cys | Lys |
| — | Lys | D-Cys | Cys | Glu | Leu | D-Cys | Cys | Asn | Pro | Ala | Cys | Thr | Gly | D-Cys | Tyr |
| — | Lys | D-Cys | Cys | Glu | Leu | D-Cys | Cys | Thr | Pro | Ala | Cys | Thr | Gly | Cys | — |
| — | Lys | D-Cys | Cys | Glu | Leu | D-Cys | Cys | Thr | Pro | Ala | Cys | Thr | Gly | Cys | Lys |
| — | Lys | D-Cys | Cys | Glu | Leu | D-Cys | Cys | Thr | Pro | Ala | Cys | Thr | Gly | Cys | Tyr |
| — | Lys | D-Cys | Cys | Glu | Leu | D-Cys | Cys | Thr | Pro | Ala | Cys | Thr | Gly | D-Cys | — |
| — | Lys | D-Cys | Cys | Glu | Leu | D-Cys | Cys | Thr | Pro | Ala | Cys | Thr | Gly | D-Cys | Lys |
| — | Lys | D-Cys | Cys | Glu | Leu | D-Cys | Cys | Thr | Pro | Ala | Cys | Thr | Gly | D-Cys | Tyr |
| — | Lys | D-Cys | Cys | Glu | Tyr | Cys | Cys | Asn | Pro | Ala | Cys | Thr | Gly | Cys | — |
| — | Lys | D-Cys | Cys | Glu | Tyr | Cys | Cys | Asn | Pro | Ala | Cys | Thr | Gly | Cys | Lys |
| — | Lys | D-Cys | Cys | Glu | Tyr | Cys | Cys | Asn | Pro | Ala | Cys | Thr | Gly | Cys | Tyr |

FIG. 3A-18

| | | | | | | | | | | | | | | |
|---|---|---|---|---|---|---|---|---|---|---|---|---|---|---|
| — | Lys | D-Cys | Cys | Glu | Tyr | Cys | Cys | Asn | Pro | Ala | Cys | Thr | Gly | D-Cys | — |
| — | Lys | D-Cys | Cys | Glu | Tyr | Cys | Cys | Asn | Pro | Ala | Cys | Thr | Gly | D-Cys | Lys |
| — | Lys | D-Cys | Cys | Glu | Tyr | Cys | Cys | Asn | Pro | Ala | Cys | Thr | Gly | D-Cys | Tyr |
| — | Lys | D-Cys | Cys | Glu | Tyr | Cys | Cys | Thr | Pro | Ala | Cys | Thr | Gly | Cys | — |
| — | Lys | D-Cys | Cys | Glu | Tyr | Cys | Cys | Thr | Pro | Ala | Cys | Thr | Gly | Cys | Lys |
| — | Lys | D-Cys | Cys | Glu | Tyr | Cys | Cys | Thr | Pro | Ala | Cys | Thr | Gly | Cys | Tyr |
| — | Lys | D-Cys | Cys | Glu | Tyr | Cys | Cys | Thr | Pro | Ala | Cys | Thr | Gly | D-Cys | — |
| — | Lys | D-Cys | Cys | Glu | Tyr | Cys | Cys | Thr | Pro | Ala | Cys | Thr | Gly | D-Cys | Lys |
| — | Lys | D-Cys | Cys | Glu | Tyr | Cys | Cys | Thr | Pro | Ala | Cys | Thr | Gly | D-Cys | Tyr |
| — | Lys | D-Cys | Cys | Glu | Tyr | D-Cys | Cys | Asn | Pro | Ala | Cys | Thr | Gly | Cys | — |
| — | Lys | D-Cys | Cys | Glu | Tyr | D-Cys | Cys | Asn | Pro | Ala | Cys | Thr | Gly | Cys | Lys |
| — | Lys | D-Cys | Cys | Glu | Tyr | D-Cys | Cys | Asn | Pro | Ala | Cys | Thr | Gly | Cys | Tyr |
| — | Lys | D-Cys | Cys | Glu | Tyr | D-Cys | Cys | Asn | Pro | Ala | Cys | Thr | Gly | D-Cys | — |
| — | Lys | D-Cys | Cys | Glu | Tyr | D-Cys | Cys | Asn | Pro | Ala | Cys | Thr | Gly | D-Cys | Lys |
| — | Lys | D-Cys | Cys | Glu | Tyr | D-Cys | Cys | Asn | Pro | Ala | Cys | Thr | Gly | D-Cys | Tyr |
| — | Lys | D-Cys | Cys | Glu | Tyr | D-Cys | Cys | Thr | Pro | Ala | Cys | Thr | Gly | Cys | — |
| — | Lys | D-Cys | Cys | Glu | Tyr | D-Cys | Cys | Thr | Pro | Ala | Cys | Thr | Gly | Cys | Lys |
| — | Lys | D-Cys | Cys | Glu | Tyr | D-Cys | Cys | Thr | Pro | Ala | Cys | Thr | Gly | Cys | Tyr |
| — | Lys | D-Cys | Cys | Glu | Tyr | D-Cys | Cys | Thr | Pro | Ala | Cys | Thr | Gly | D-Cys | — |
| — | Lys | D-Cys | Cys | Glu | Tyr | D-Cys | Cys | Thr | Pro | Ala | Cys | Thr | Gly | D-Cys | Lys |
| — | Lys | D-Cys | Cys | Glu | Tyr | D-Cys | Cys | Thr | Pro | Ala | Cys | Thr | Gly | D-Cys | Tyr |
| — | Lys | D-Cys | Cys | Glu | Phe | Cys | Cys | Asn | Pro | Ala | Cys | Thr | Gly | Cys | — |
| — | Lys | D-Cys | Cys | Glu | Phe | Cys | Cys | Asn | Pro | Ala | Cys | Thr | Gly | Cys | Lys |
| — | Lys | D-Cys | Cys | Glu | Phe | Cys | Cys | Asn | Pro | Ala | Cys | Thr | Gly | Cys | Tyr |
| — | Lys | D-Cys | Cys | Glu | Phe | Cys | Cys | Asn | Pro | Ala | Cys | Thr | Gly | D-Cys | — |
| — | Lys | D-Cys | Cys | Glu | Phe | Cys | Cys | Asn | Pro | Ala | Cys | Thr | Gly | D-Cys | Lys |
| — | Lys | D-Cys | Cys | Glu | Phe | Cys | Cys | Asn | Pro | Ala | Cys | Thr | Gly | D-Cys | Tyr |
| — | Lys | D-Cys | Cys | Glu | Phe | Cys | Cys | Thr | Pro | Ala | Cys | Thr | Gly | Cys | — |
| — | Lys | D-Cys | Cys | Glu | Phe | Cys | Cys | Thr | Pro | Ala | Cys | Thr | Gly | Cys | Lys |
| — | Lys | D-Cys | Cys | Glu | Phe | Cys | Cys | Thr | Pro | Ala | Cys | Thr | Gly | Cys | Tyr |
| — | Lys | D-Cys | Cys | Glu | Phe | Cys | Cys | Thr | Pro | Ala | Cys | Thr | Gly | D-Cys | — |
| — | Lys | D-Cys | Cys | Glu | Phe | Cys | Cys | Thr | Pro | Ala | Cys | Thr | Gly | D-Cys | Lys |
| — | Lys | D-Cys | Cys | Glu | Phe | Cys | Cys | Thr | Pro | Ala | Cys | Thr | Gly | D-Cys | Tyr |
| — | Lys | D-Cys | Cys | Glu | Phe | D-Cys | Cys | Asn | Pro | Ala | Cys | Thr | Gly | Cys | — |
| — | Lys | D-Cys | Cys | Glu | Phe | D-Cys | Cys | Asn | Pro | Ala | Cys | Thr | Gly | Cys | Lys |
| — | Lys | D-Cys | Cys | Glu | Phe | D-Cys | Cys | Asn | Pro | Ala | Cys | Thr | Gly | Cys | Tyr |
| — | Lys | D-Cys | Cys | Glu | Phe | D-Cys | Cys | Asn | Pro | Ala | Cys | Thr | Gly | D-Cys | — |
| — | Lys | D-Cys | Cys | Glu | Phe | D-Cys | Cys | Asn | Pro | Ala | Cys | Thr | Gly | D-Cys | Lys |
| — | Lys | D-Cys | Cys | Glu | Phe | D-Cys | Cys | Asn | Pro | Ala | Cys | Thr | Gly | D-Cys | Tyr |
| — | Lys | D-Cys | Cys | Glu | Phe | D-Cys | Cys | Thr | Pro | Ala | Cys | Thr | Gly | Cys | — |
| — | Lys | D-Cys | Cys | Glu | Phe | D-Cys | Cys | Thr | Pro | Ala | Cys | Thr | Gly | Cys | Lys |
| — | Lys | D-Cys | Cys | Glu | Phe | D-Cys | Cys | Thr | Pro | Ala | Cys | Thr | Gly | Cys | Tyr |
| — | Lys | D-Cys | Cys | Glu | Phe | D-Cys | Cys | Thr | Pro | Ala | Cys | Thr | Gly | D-Cys | — |
| — | Lys | D-Cys | Cys | Glu | Phe | D-Cys | Cys | Thr | Pro | Ala | Cys | Thr | Gly | D-Cys | Lys |
| — | Lys | D-Cys | Cys | Glu | Phe | D-Cys | Cys | Thr | Pro | Ala | Cys | Thr | Gly | D-Cys | Tyr |
| — | Lys | D-Cys | Cys | Glu | Trp | Cys | Cys | Asn | Pro | Ala | Cys | Thr | Gly | Cys | — |
| — | Lys | D-Cys | Cys | Glu | Trp | Cys | Cys | Asn | Pro | Ala | Cys | Thr | Gly | Cys | Lys |
| — | Lys | D-Cys | Cys | Glu | Trp | Cys | Cys | Asn | Pro | Ala | Cys | Thr | Gly | Cys | Tyr |
| — | Lys | D-Cys | Cys | Glu | Trp | Cys | Cys | Asn | Pro | Ala | Cys | Thr | Gly | D-Cys | — |
| — | Lys | D-Cys | Cys | Glu | Trp | Cys | Cys | Asn | Pro | Ala | Cys | Thr | Gly | D-Cys | Lys |
| — | Lys | D-Cys | Cys | Glu | Trp | Cys | Cys | Asn | Pro | Ala | Cys | Thr | Gly | D-Cys | Tyr |
| — | Lys | D-Cys | Cys | Glu | Trp | Cys | Cys | Thr | Pro | Ala | Cys | Thr | Gly | Cys | — |
| — | Lys | D-Cys | Cys | Glu | Trp | Cys | Cys | Thr | Pro | Ala | Cys | Thr | Gly | Cys | Lys |
| — | Lys | D-Cys | Cys | Glu | Trp | Cys | Cys | Thr | Pro | Ala | Cys | Thr | Gly | Cys | Tyr |
| — | Lys | D-Cys | Cys | Glu | Trp | Cys | Cys | Thr | Pro | Ala | Cys | Thr | Gly | D-Cys | — |
| — | Lys | D-Cys | Cys | Glu | Trp | Cys | Cys | Thr | Pro | Ala | Cys | Thr | Gly | D-Cys | Lys |
| — | Lys | D-Cys | Cys | Glu | Trp | Cys | Cys | Thr | Pro | Ala | Cys | Thr | Gly | D-Cys | Tyr |
| — | Lys | D-Cys | Cys | Glu | Trp | D-Cys | Cys | Asn | Pro | Ala | Cys | Thr | Gly | Cys | — |
| — | Lys | D-Cys | Cys | Glu | Trp | D-Cys | Cys | Asn | Pro | Ala | Cys | Thr | Gly | Cys | Lys |
| — | Lys | D-Cys | Cys | Glu | Trp | D-Cys | Cys | Asn | Pro | Ala | Cys | Thr | Gly | Cys | Tyr |

FIG. 3A-19

| | | | | | | | | | | | | | |
|---|---|---|---|---|---|---|---|---|---|---|---|---|---|
| — | Lys | D-Cys | Cys | Glu | Trp | D-Cys | Cys | Asn | Pro | Ala | Cys | Thr | Gly | D-Cys | — |
| — | Lys | D-Cys | Cys | Glu | Trp | D-Cys | Cys | Asn | Pro | Ala | Cys | Thr | Gly | D-Cys | Lys |
| — | Lys | D-Cys | Cys | Glu | Trp | D-Cys | Cys | Asn | Pro | Ala | Cys | Thr | Gly | D-Cys | Tyr |
| — | Lys | D-Cys | Cys | Glu | Trp | D-Cys | Cys | Thr | Pro | Ala | Cys | Thr | Gly | Cys | — |
| — | Lys | D-Cys | Cys | Glu | Trp | D-Cys | Cys | Thr | Pro | Ala | Cys | Thr | Gly | Cys | Lys |
| — | Lys | D-Cys | Cys | Glu | Trp | D-Cys | Cys | Thr | Pro | Ala | Cys | Thr | Gly | Cys | Tyr |
| — | Lys | D-Cys | Cys | Glu | Trp | D-Cys | Cys | Thr | Pro | Ala | Cys | Thr | Gly | D-Cys | — |
| — | Lys | D-Cys | Cys | Glu | Trp | D-Cys | Cys | Thr | Pro | Ala | Cys | Thr | Gly | D-Cys | Lys |
| — | Lys | D-Cys | Cys | Glu | Trp | D-Cys | Cys | Thr | Pro | Ala | Cys | Thr | Gly | D-Cys | Tyr |
| — | Ser | Cys | Cys | Glu | Val | Cys | Cys | Asn | Pro | Ala | Cys | Thr | Gly | Cys | — |
| — | Ser | Cys | Cys | Glu | Val | Cys | Cys | Asn | Pro | Ala | Cys | Thr | Gly | Cys | Lys |
| — | Ser | Cys | Cys | Glu | Val | Cys | Cys | Asn | Pro | Ala | Cys | Thr | Gly | Cys | Tyr |
| — | Ser | Cys | Cys | Glu | Val | Cys | Cys | Asn | Pro | Ala | Cys | Thr | Gly | D-Cys | — |
| — | Ser | Cys | Cys | Glu | Val | Cys | Cys | Asn | Pro | Ala | Cys | Thr | Gly | D-Cys | Lys |
| — | Ser | Cys | Cys | Glu | Val | Cys | Cys | Asn | Pro | Ala | Cys | Thr | Gly | D-Cys | Tyr |
| — | Ser | Cys | Cys | Glu | Val | Cys | Cys | Thr | Pro | Ala | Cys | Thr | Gly | Cys | — |
| — | Ser | Cys | Cys | Glu | Val | Cys | Cys | Thr | Pro | Ala | Cys | Thr | Gly | Cys | Lys |
| — | Ser | Cys | Cys | Glu | Val | Cys | Cys | Thr | Pro | Ala | Cys | Thr | Gly | Cys | Tyr |
| — | Ser | Cys | Cys | Glu | Val | Cys | Cys | Thr | Pro | Ala | Cys | Thr | Gly | D-Cys | — |
| — | Ser | Cys | Cys | Glu | Val | Cys | Cys | Thr | Pro | Ala | Cys | Thr | Gly | D-Cys | Lys |
| — | Ser | Cys | Cys | Glu | Val | Cys | Cys | Thr | Pro | Ala | Cys | Thr | Gly | D-Cys | Tyr |
| — | Ser | Cys | Cys | Glu | Val | D-Cys | Cys | Asn | Pro | Ala | Cys | Thr | Gly | Cys | — |
| — | Ser | Cys | Cys | Glu | Val | D-Cys | Cys | Asn | Pro | Ala | Cys | Thr | Gly | Cys | Lys |
| — | Ser | Cys | Cys | Glu | Val | D-Cys | Cys | Asn | Pro | Ala | Cys | Thr | Gly | Cys | Tyr |
| — | Ser | Cys | Cys | Glu | Val | D-Cys | Cys | Asn | Pro | Ala | Cys | Thr | Gly | D-Cys | — |
| — | Ser | Cys | Cys | Glu | Val | D-Cys | Cys | Asn | Pro | Ala | Cys | Thr | Gly | D-Cys | Lys |
| — | Ser | Cys | Cys | Glu | Val | D-Cys | Cys | Asn | Pro | Ala | Cys | Thr | Gly | D-Cys | Tyr |
| — | Ser | Cys | Cys | Glu | Val | D-Cys | Cys | Thr | Pro | Ala | Cys | Thr | Gly | Cys | — |
| — | Ser | Cys | Cys | Glu | Val | D-Cys | Cys | Thr | Pro | Ala | Cys | Thr | Gly | Cys | Lys |
| — | Ser | Cys | Cys | Glu | Val | D-Cys | Cys | Thr | Pro | Ala | Cys | Thr | Gly | Cys | Tyr |
| — | Ser | Cys | Cys | Glu | Val | D-Cys | Cys | Thr | Pro | Ala | Cys | Thr | Gly | D-Cys | — |
| — | Ser | Cys | Cys | Glu | Val | D-Cys | Cys | Thr | Pro | Ala | Cys | Thr | Gly | D-Cys | Lys |
| — | Ser | Cys | Cys | Glu | Val | D-Cys | Cys | Thr | Pro | Ala | Cys | Thr | Gly | D-Cys | Tyr |
| — | Ser | Cys | Cys | Glu | Ile | Cys | Cys | Asn | Pro | Ala | Cys | Thr | Gly | Cys | — |
| — | Ser | Cys | Cys | Glu | Ile | Cys | Cys | Asn | Pro | Ala | Cys | Thr | Gly | Cys | Lys |
| — | Ser | Cys | Cys | Glu | Ile | Cys | Cys | Asn | Pro | Ala | Cys | Thr | Gly | Cys | Tyr |
| — | Ser | Cys | Cys | Glu | Ile | Cys | Cys | Asn | Pro | Ala | Cys | Thr | Gly | D-Cys | — |
| — | Ser | Cys | Cys | Glu | Ile | Cys | Cys | Asn | Pro | Ala | Cys | Thr | Gly | D-Cys | Lys |
| — | Ser | Cys | Cys | Glu | Ile | Cys | Cys | Asn | Pro | Ala | Cys | Thr | Gly | D-Cys | Tyr |
| — | Ser | Cys | Cys | Glu | Ile | Cys | Cys | Thr | Pro | Ala | Cys | Thr | Gly | Cys | — |
| — | Ser | Cys | Cys | Glu | Ile | Cys | Cys | Thr | Pro | Ala | Cys | Thr | Gly | Cys | Lys |
| — | Ser | Cys | Cys | Glu | Ile | Cys | Cys | Thr | Pro | Ala | Cys | Thr | Gly | Cys | Tyr |
| — | Ser | Cys | Cys | Glu | Ile | Cys | Cys | Thr | Pro | Ala | Cys | Thr | Gly | D-Cys | — |
| — | Ser | Cys | Cys | Glu | Ile | Cys | Cys | Thr | Pro | Ala | Cys | Thr | Gly | D-Cys | Lys |
| — | Ser | Cys | Cys | Glu | Ile | Cys | Cys | Thr | Pro | Ala | Cys | Thr | Gly | D-Cys | Tyr |
| — | Ser | Cys | Cys | Glu | Ile | D-Cys | Cys | Asn | Pro | Ala | Cys | Thr | Gly | Cys | — |
| — | Ser | Cys | Cys | Glu | Ile | D-Cys | Cys | Asn | Pro | Ala | Cys | Thr | Gly | Cys | Lys |
| — | Ser | Cys | Cys | Glu | Ile | D-Cys | Cys | Asn | Pro | Ala | Cys | Thr | Gly | Cys | Tyr |
| — | Ser | Cys | Cys | Glu | Ile | D-Cys | Cys | Asn | Pro | Ala | Cys | Thr | Gly | D-Cys | — |
| — | Ser | Cys | Cys | Glu | Ile | D-Cys | Cys | Asn | Pro | Ala | Cys | Thr | Gly | D-Cys | Lys |
| — | Ser | Cys | Cys | Glu | Ile | D-Cys | Cys | Asn | Pro | Ala | Cys | Thr | Gly | D-Cys | Tyr |
| — | Ser | Cys | Cys | Glu | Ile | D-Cys | Cys | Thr | Pro | Ala | Cys | Thr | Gly | Cys | — |
| — | Ser | Cys | Cys | Glu | Ile | D-Cys | Cys | Thr | Pro | Ala | Cys | Thr | Gly | Cys | Lys |
| — | Ser | Cys | Cys | Glu | Ile | D-Cys | Cys | Thr | Pro | Ala | Cys | Thr | Gly | Cys | Tyr |
| — | Ser | Cys | Cys | Glu | Ile | D-Cys | Cys | Thr | Pro | Ala | Cys | Thr | Gly | D-Cys | — |
| — | Ser | Cys | Cys | Glu | Ile | D-Cys | Cys | Thr | Pro | Ala | Cys | Thr | Gly | D-Cys | Lys |
| — | Ser | Cys | Cys | Glu | Ile | D-Cys | Cys | Thr | Pro | Ala | Cys | Thr | Gly | D-Cys | Tyr |
| — | Ser | Cys | Cys | Glu | Leu | Cys | Cys | Asn | Pro | Ala | Cys | Thr | Gly | Cys | — |
| — | Ser | Cys | Cys | Glu | Leu | Cys | Cys | Asn | Pro | Ala | Cys | Thr | Gly | Cys | Lys |
| — | Ser | Cys | Cys | Glu | Leu | Cys | Cys | Asn | Pro | Ala | Cys | Thr | Gly | Cys | Tyr |

FIG. 3A-20

| | | | | | | | | | | | | | | |
|---|---|---|---|---|---|---|---|---|---|---|---|---|---|---|
| — | Ser | Cys | Cys | Glu | Leu | Cys | Cys | Asn | Pro | Ala | Cys | Thr | Gly | D-Cys | — |
| — | Ser | Cys | Cys | Glu | Leu | Cys | Cys | Asn | Pro | Ala | Cys | Thr | Gly | D-Cys | Lys |
| — | Ser | Cys | Cys | Glu | Leu | Cys | Cys | Asn | Pro | Ala | Cys | Thr | Gly | D-Cys | Tyr |
| — | Ser | Cys | Cys | Glu | Leu | Cys | Cys | Thr | Pro | Ala | Cys | Thr | Gly | Cys | — |
| — | Ser | Cys | Cys | Glu | Leu | Cys | Cys | Thr | Pro | Ala | Cys | Thr | Gly | Cys | Lys |
| — | Ser | Cys | Cys | Glu | Leu | Cys | Cys | Thr | Pro | Ala | Cys | Thr | Gly | Cys | Tyr |
| — | Ser | Cys | Cys | Glu | Leu | Cys | Cys | Thr | Pro | Ala | Cys | Thr | Gly | D-Cys | — |
| — | Ser | Cys | Cys | Glu | Leu | Cys | Cys | Thr | Pro | Ala | Cys | Thr | Gly | D-Cys | Lys |
| — | Ser | Cys | Cys | Glu | Leu | Cys | Cys | Thr | Pro | Ala | Cys | Thr | Gly | D-Cys | Tyr |
| — | Ser | Cys | Cys | Glu | Leu | D-Cys | Cys | Asn | Pro | Ala | Cys | Thr | Gly | Cys | — |
| — | Ser | Cys | Cys | Glu | Leu | D-Cys | Cys | Asn | Pro | Ala | Cys | Thr | Gly | Cys | Lys |
| — | Ser | Cys | Cys | Glu | Leu | D-Cys | Cys | Asn | Pro | Ala | Cys | Thr | Gly | Cys | Tyr |
| — | Ser | Cys | Cys | Glu | Leu | D-Cys | Cys | Asn | Pro | Ala | Cys | Thr | Gly | D-Cys | — |
| — | Ser | Cys | Cys | Glu | Leu | D-Cys | Cys | Asn | Pro | Ala | Cys | Thr | Gly | D-Cys | Lys |
| — | Ser | Cys | Cys | Glu | Leu | D-Cys | Cys | Asn | Pro | Ala | Cys | Thr | Gly | D-Cys | Tyr |
| — | Ser | Cys | Cys | Glu | Leu | D-Cys | Cys | Thr | Pro | Ala | Cys | Thr | Gly | Cys | — |
| — | Ser | Cys | Cys | Glu | Leu | D-Cys | Cys | Thr | Pro | Ala | Cys | Thr | Gly | Cys | Lys |
| — | Ser | Cys | Cys | Glu | Leu | D-Cys | Cys | Thr | Pro | Ala | Cys | Thr | Gly | Cys | Tyr |
| — | Ser | Cys | Cys | Glu | Leu | D-Cys | Cys | Thr | Pro | Ala | Cys | Thr | Gly | D-Cys | — |
| — | Ser | Cys | Cys | Glu | Leu | D-Cys | Cys | Thr | Pro | Ala | Cys | Thr | Gly | D-Cys | Lys |
| — | Ser | Cys | Cys | Glu | Leu | D-Cys | Cys | Thr | Pro | Ala | Cys | Thr | Gly | D-Cys | Tyr |
| — | Ser | Cys | Cys | Glu | Tyr | Cys | Cys | Asn | Pro | Ala | Cys | Thr | Gly | Cys | — |
| — | Ser | Cys | Cys | Glu | Tyr | Cys | Cys | Asn | Pro | Ala | Cys | Thr | Gly | Cys | Lys |
| — | Ser | Cys | Cys | Glu | Tyr | Cys | Cys | Asn | Pro | Ala | Cys | Thr | Gly | Cys | Tyr |
| — | Ser | Cys | Cys | Glu | Tyr | Cys | Cys | Asn | Pro | Ala | Cys | Thr | Gly | D-Cys | — |
| — | Ser | Cys | Cys | Glu | Tyr | Cys | Cys | Asn | Pro | Ala | Cys | Thr | Gly | D-Cys | Lys |
| — | Ser | Cys | Cys | Glu | Tyr | Cys | Cys | Asn | Pro | Ala | Cys | Thr | Gly | D-Cys | Tyr |
| — | Ser | Cys | Cys | Glu | Tyr | Cys | Cys | Thr | Pro | Ala | Cys | Thr | Gly | Cys | — |
| — | Ser | Cys | Cys | Glu | Tyr | Cys | Cys | Thr | Pro | Ala | Cys | Thr | Gly | Cys | Lys |
| — | Ser | Cys | Cys | Glu | Tyr | Cys | Cys | Thr | Pro | Ala | Cys | Thr | Gly | Cys | Tyr |
| — | Ser | Cys | Cys | Glu | Tyr | Cys | Cys | Thr | Pro | Ala | Cys | Thr | Gly | D-Cys | — |
| — | Ser | Cys | Cys | Glu | Tyr | Cys | Cys | Thr | Pro | Ala | Cys | Thr | Gly | D-Cys | Lys |
| — | Ser | Cys | Cys | Glu | Tyr | Cys | Cys | Thr | Pro | Ala | Cys | Thr | Gly | D-Cys | Tyr |
| — | Ser | Cys | Cys | Glu | Tyr | D-Cys | Cys | Asn | Pro | Ala | Cys | Thr | Gly | Cys | — |
| — | Ser | Cys | Cys | Glu | Tyr | D-Cys | Cys | Asn | Pro | Ala | Cys | Thr | Gly | Cys | Lys |
| — | Ser | Cys | Cys | Glu | Tyr | D-Cys | Cys | Asn | Pro | Ala | Cys | Thr | Gly | Cys | Tyr |
| — | Ser | Cys | Cys | Glu | Tyr | D-Cys | Cys | Asn | Pro | Ala | Cys | Thr | Gly | D-Cys | — |
| — | Ser | Cys | Cys | Glu | Tyr | D-Cys | Cys | Asn | Pro | Ala | Cys | Thr | Gly | D-Cys | Lys |
| — | Ser | Cys | Cys | Glu | Tyr | D-Cys | Cys | Asn | Pro | Ala | Cys | Thr | Gly | D-Cys | Tyr |
| — | Ser | Cys | Cys | Glu | Tyr | D-Cys | Cys | Thr | Pro | Ala | Cys | Thr | Gly | Cys | — |
| — | Ser | Cys | Cys | Glu | Tyr | D-Cys | Cys | Thr | Pro | Ala | Cys | Thr | Gly | Cys | Lys |
| — | Ser | Cys | Cys | Glu | Tyr | D-Cys | Cys | Thr | Pro | Ala | Cys | Thr | Gly | Cys | Tyr |
| — | Ser | Cys | Cys | Glu | Tyr | D-Cys | Cys | Thr | Pro | Ala | Cys | Thr | Gly | D-Cys | — |
| — | Ser | Cys | Cys | Glu | Tyr | D-Cys | Cys | Thr | Pro | Ala | Cys | Thr | Gly | D-Cys | Lys |
| — | Ser | Cys | Cys | Glu | Tyr | D-Cys | Cys | Thr | Pro | Ala | Cys | Thr | Gly | D-Cys | Tyr |
| — | Ser | Cys | Cys | Glu | Phe | Cys | Cys | Asn | Pro | Ala | Cys | Thr | Gly | Cys | — |
| — | Ser | Cys | Cys | Glu | Phe | Cys | Cys | Asn | Pro | Ala | Cys | Thr | Gly | Cys | Lys |
| — | Ser | Cys | Cys | Glu | Phe | Cys | Cys | Asn | Pro | Ala | Cys | Thr | Gly | Cys | Tyr |
| — | Ser | Cys | Cys | Glu | Phe | Cys | Cys | Asn | Pro | Ala | Cys | Thr | Gly | D-Cys | — |
| — | Ser | Cys | Cys | Glu | Phe | Cys | Cys | Asn | Pro | Ala | Cys | Thr | Gly | D-Cys | Lys |
| — | Ser | Cys | Cys | Glu | Phe | Cys | Cys | Asn | Pro | Ala | Cys | Thr | Gly | D-Cys | Tyr |
| — | Ser | Cys | Cys | Glu | Phe | Cys | Cys | Thr | Pro | Ala | Cys | Thr | Gly | Cys | — |
| — | Ser | Cys | Cys | Glu | Phe | Cys | Cys | Thr | Pro | Ala | Cys | Thr | Gly | Cys | Lys |
| — | Ser | Cys | Cys | Glu | Phe | Cys | Cys | Thr | Pro | Ala | Cys | Thr | Gly | Cys | Tyr |
| — | Ser | Cys | Cys | Glu | Phe | Cys | Cys | Thr | Pro | Ala | Cys | Thr | Gly | D-Cys | — |
| — | Ser | Cys | Cys | Glu | Phe | Cys | Cys | Thr | Pro | Ala | Cys | Thr | Gly | D-Cys | Lys |
| — | Ser | Cys | Cys | Glu | Phe | Cys | Cys | Thr | Pro | Ala | Cys | Thr | Gly | D-Cys | Tyr |
| — | Ser | Cys | Cys | Glu | Phe | D-Cys | Cys | Asn | Pro | Ala | Cys | Thr | Gly | Cys | — |
| — | Ser | Cys | Cys | Glu | Phe | D-Cys | Cys | Asn | Pro | Ala | Cys | Thr | Gly | Cys | Lys |
| — | Ser | Cys | Cys | Glu | Phe | D-Cys | Cys | Asn | Pro | Ala | Cys | Thr | Gly | Cys | Tyr |

FIG. 3A-21

| | | | | | | | | | | | | | |
|---|---|---|---|---|---|---|---|---|---|---|---|---|---|
| — | Ser | Cys | Cys | Glu | Phe | D-Cys | Cys | Asn | Pro | Ala | Cys | Thr | Gly | D-Cys — |
| — | Ser | Cys | Cys | Glu | Phe | D-Cys | Cys | Asn | Pro | Ala | Cys | Thr | Gly | D-Cys Lys |
| — | Ser | Cys | Cys | Glu | Phe | D-Cys | Cys | Asn | Pro | Ala | Cys | Thr | Gly | D-Cys Tyr |
| — | Ser | Cys | Cys | Glu | Phe | D-Cys | Cys | Thr | Pro | Ala | Cys | Thr | Gly | Cys — |
| — | Ser | Cys | Cys | Glu | Phe | D-Cys | Cys | Thr | Pro | Ala | Cys | Thr | Gly | Cys Lys |
| — | Ser | Cys | Cys | Glu | Phe | D-Cys | Cys | Thr | Pro | Ala | Cys | Thr | Gly | Cys Tyr |
| — | Ser | Cys | Cys | Glu | Phe | D-Cys | Cys | Thr | Pro | Ala | Cys | Thr | Gly | D-Cys — |
| — | Ser | Cys | Cys | Glu | Phe | D-Cys | Cys | Thr | Pro | Ala | Cys | Thr | Gly | D-Cys Lys |
| — | Ser | Cys | Cys | Glu | Phe | D-Cys | Cys | Thr | Pro | Ala | Cys | Thr | Gly | D-Cys Tyr |
| — | Ser | Cys | Cys | Glu | Trp | Cys | Cys | Asn | Pro | Ala | Cys | Thr | Gly | Cys — |
| — | Ser | Cys | Cys | Glu | Trp | Cys | Cys | Asn | Pro | Ala | Cys | Thr | Gly | Cys Lys |
| — | Ser | Cys | Cys | Glu | Trp | Cys | Cys | Asn | Pro | Ala | Cys | Thr | Gly | Cys Tyr |
| — | Ser | Cys | Cys | Glu | Trp | Cys | Cys | Asn | Pro | Ala | Cys | Thr | Gly | D-Cys — |
| — | Ser | Cys | Cys | Glu | Trp | Cys | Cys | Asn | Pro | Ala | Cys | Thr | Gly | D-Cys Lys |
| — | Ser | Cys | Cys | Glu | Trp | Cys | Cys | Asn | Pro | Ala | Cys | Thr | Gly | D-Cys Tyr |
| — | Ser | Cys | Cys | Glu | Trp | Cys | Cys | Thr | Pro | Ala | Cys | Thr | Gly | Cys — |
| — | Ser | Cys | Cys | Glu | Trp | Cys | Cys | Thr | Pro | Ala | Cys | Thr | Gly | Cys Lys |
| — | Ser | Cys | Cys | Glu | Trp | Cys | Cys | Thr | Pro | Ala | Cys | Thr | Gly | Cys Tyr |
| — | Ser | Cys | Cys | Glu | Trp | Cys | Cys | Thr | Pro | Ala | Cys | Thr | Gly | D-Cys — |
| — | Ser | Cys | Cys | Glu | Trp | Cys | Cys | Thr | Pro | Ala | Cys | Thr | Gly | D-Cys Lys |
| — | Ser | Cys | Cys | Glu | Trp | Cys | Cys | Thr | Pro | Ala | Cys | Thr | Gly | D-Cys Tyr |
| — | Ser | Cys | Cys | Glu | Trp | D-Cys | Cys | Asn | Pro | Ala | Cys | Thr | Gly | Cys — |
| — | Ser | Cys | Cys | Glu | Trp | D-Cys | Cys | Asn | Pro | Ala | Cys | Thr | Gly | Cys Lys |
| — | Ser | Cys | Cys | Glu | Trp | D-Cys | Cys | Asn | Pro | Ala | Cys | Thr | Gly | Cys Tyr |
| — | Ser | Cys | Cys | Glu | Trp | D-Cys | Cys | Asn | Pro | Ala | Cys | Thr | Gly | D-Cys — |
| — | Ser | Cys | Cys | Glu | Trp | D-Cys | Cys | Asn | Pro | Ala | Cys | Thr | Gly | D-Cys Lys |
| — | Ser | Cys | Cys | Glu | Trp | D-Cys | Cys | Asn | Pro | Ala | Cys | Thr | Gly | D-Cys Tyr |
| — | Ser | Cys | Cys | Glu | Trp | D-Cys | Cys | Thr | Pro | Ala | Cys | Thr | Gly | Cys — |
| — | Ser | Cys | Cys | Glu | Trp | D-Cys | Cys | Thr | Pro | Ala | Cys | Thr | Gly | Cys Lys |
| — | Ser | Cys | Cys | Glu | Trp | D-Cys | Cys | Thr | Pro | Ala | Cys | Thr | Gly | Cys Tyr |
| — | Ser | Cys | Cys | Glu | Trp | D-Cys | Cys | Thr | Pro | Ala | Cys | Thr | Gly | D-Cys — |
| — | Ser | Cys | Cys | Glu | Trp | D-Cys | Cys | Thr | Pro | Ala | Cys | Thr | Gly | D-Cys Lys |
| — | Ser | Cys | Cys | Glu | Trp | D-Cys | Cys | Thr | Pro | Ala | Cys | Thr | Gly | D-Cys Tyr |
| — | Ser | D-Cys | Cys | Glu | Val | Cys | Cys | Asn | Pro | Ala | Cys | Thr | Gly | Cys — |
| — | Ser | D-Cys | Cys | Glu | Val | Cys | Cys | Asn | Pro | Ala | Cys | Thr | Gly | Cys Lys |
| — | Ser | D-Cys | Cys | Glu | Val | Cys | Cys | Asn | Pro | Ala | Cys | Thr | Gly | Cys Tyr |
| — | Ser | D-Cys | Cys | Glu | Val | Cys | Cys | Asn | Pro | Ala | Cys | Thr | Gly | D-Cys — |
| — | Ser | D-Cys | Cys | Glu | Val | Cys | Cys | Asn | Pro | Ala | Cys | Thr | Gly | D-Cys Lys |
| — | Ser | D-Cys | Cys | Glu | Val | Cys | Cys | Asn | Pro | Ala | Cys | Thr | Gly | D-Cys Tyr |
| — | Ser | D-Cys | Cys | Glu | Val | Cys | Cys | Thr | Pro | Ala | Cys | Thr | Gly | Cys — |
| — | Ser | D-Cys | Cys | Glu | Val | Cys | Cys | Thr | Pro | Ala | Cys | Thr | Gly | Cys Lys |
| — | Ser | D-Cys | Cys | Glu | Val | Cys | Cys | Thr | Pro | Ala | Cys | Thr | Gly | Cys Tyr |
| — | Ser | D-Cys | Cys | Glu | Val | Cys | Cys | Thr | Pro | Ala | Cys | Thr | Gly | D-Cys — |
| — | Ser | D-Cys | Cys | Glu | Val | Cys | Cys | Thr | Pro | Ala | Cys | Thr | Gly | D-Cys Lys |
| — | Ser | D-Cys | Cys | Glu | Val | Cys | Cys | Thr | Pro | Ala | Cys | Thr | Gly | D-Cys Tyr |
| — | Ser | D-Cys | Cys | Glu | Val | D-Cys | Cys | Asn | Pro | Ala | Cys | Thr | Gly | Cys — |
| — | Ser | D-Cys | Cys | Glu | Val | D-Cys | Cys | Asn | Pro | Ala | Cys | Thr | Gly | Cys Lys |
| — | Ser | D-Cys | Cys | Glu | Val | D-Cys | Cys | Asn | Pro | Ala | Cys | Thr | Gly | Cys Tyr |
| — | Ser | D-Cys | Cys | Glu | Val | D-Cys | Cys | Asn | Pro | Ala | Cys | Thr | Gly | D-Cys — |
| — | Ser | D-Cys | Cys | Glu | Val | D-Cys | Cys | Asn | Pro | Ala | Cys | Thr | Gly | D-Cys Lys |
| — | Ser | D-Cys | Cys | Glu | Val | D-Cys | Cys | Asn | Pro | Ala | Cys | Thr | Gly | D-Cys Tyr |
| — | Ser | D-Cys | Cys | Glu | Val | D-Cys | Cys | Thr | Pro | Ala | Cys | Thr | Gly | Cys — |
| — | Ser | D-Cys | Cys | Glu | Val | D-Cys | Cys | Thr | Pro | Ala | Cys | Thr | Gly | Cys Lys |
| — | Ser | D-Cys | Cys | Glu | Val | D-Cys | Cys | Thr | Pro | Ala | Cys | Thr | Gly | Cys Tyr |
| — | Ser | D-Cys | Cys | Glu | Val | D-Cys | Cys | Thr | Pro | Ala | Cys | Thr | Gly | D-Cys — |
| — | Ser | D-Cys | Cys | Glu | Val | D-Cys | Cys | Thr | Pro | Ala | Cys | Thr | Gly | D-Cys Lys |
| — | Ser | D-Cys | Cys | Glu | Val | D-Cys | Cys | Thr | Pro | Ala | Cys | Thr | Gly | D-Cys Tyr |
| — | Ser | D-Cys | Cys | Glu | Ile | Cys | Cys | Asn | Pro | Ala | Cys | Thr | Gly | Cys — |
| — | Ser | D-Cys | Cys | Glu | Ile | Cys | Cys | Asn | Pro | Ala | Cys | Thr | Gly | Cys Lys |
| — | Ser | D-Cys | Cys | Glu | Ile | Cys | Cys | Asn | Pro | Ala | Cys | Thr | Gly | Cys Tyr |

FIG. 3A-22

| — | Ser | D-Cys | Cys | Glu | Ile | Cys | Cys | Asn | Pro | Ala | Cys | Thr | Gly | D-Cys | — |
| — | Ser | D-Cys | Cys | Glu | Ile | Cys | Cys | Asn | Pro | Ala | Cys | Thr | Gly | D-Cys | Lys |
| — | Ser | D-Cys | Cys | Glu | Ile | Cys | Cys | Asn | Pro | Ala | Cys | Thr | Gly | D-Cys | Tyr |
| — | Ser | D-Cys | Cys | Glu | Ile | Cys | Cys | Thr | Pro | Ala | Cys | Thr | Gly | Cys | — |
| — | Ser | D-Cys | Cys | Glu | Ile | Cys | Cys | Thr | Pro | Ala | Cys | Thr | Gly | Cys | Lys |
| — | Ser | D-Cys | Cys | Glu | Ile | Cys | Cys | Thr | Pro | Ala | Cys | Thr | Gly | Cys | Tyr |
| — | Ser | D-Cys | Cys | Glu | Ile | Cys | Cys | Thr | Pro | Ala | Cys | Thr | Gly | D-Cys | — |
| — | Ser | D-Cys | Cys | Glu | Ile | Cys | Cys | Thr | Pro | Ala | Cys | Thr | Gly | D-Cys | Lys |
| — | Ser | D-Cys | Cys | Glu | Ile | Cys | Cys | Thr | Pro | Ala | Cys | Thr | Gly | D-Cys | Tyr |
| — | Ser | D-Cys | Cys | Glu | Ile | D-Cys | Cys | Asn | Pro | Ala | Cys | Thr | Gly | Cys | — |
| — | Ser | D-Cys | Cys | Glu | Ile | D-Cys | Cys | Asn | Pro | Ala | Cys | Thr | Gly | Cys | Lys |
| — | Ser | D-Cys | Cys | Glu | Ile | D-Cys | Cys | Asn | Pro | Ala | Cys | Thr | Gly | Cys | Tyr |
| — | Ser | D-Cys | Cys | Glu | Ile | D-Cys | Cys | Asn | Pro | Ala | Cys | Thr | Gly | D-Cys | — |
| — | Ser | D-Cys | Cys | Glu | Ile | D-Cys | Cys | Asn | Pro | Ala | Cys | Thr | Gly | D-Cys | Lys |
| — | Ser | D-Cys | Cys | Glu | Ile | D-Cys | Cys | Asn | Pro | Ala | Cys | Thr | Gly | D-Cys | Tyr |
| — | Ser | D-Cys | Cys | Glu | Ile | D-Cys | Cys | Thr | Pro | Ala | Cys | Thr | Gly | Cys | — |
| — | Ser | D-Cys | Cys | Glu | Ile | D-Cys | Cys | Thr | Pro | Ala | Cys | Thr | Gly | Cys | Lys |
| — | Ser | D-Cys | Cys | Glu | Ile | D-Cys | Cys | Thr | Pro | Ala | Cys | Thr | Gly | Cys | Tyr |
| — | Ser | D-Cys | Cys | Glu | Ile | D-Cys | Cys | Thr | Pro | Ala | Cys | Thr | Gly | D-Cys | — |
| — | Ser | D-Cys | Cys | Glu | Ile | D-Cys | Cys | Thr | Pro | Ala | Cys | Thr | Gly | D-Cys | Lys |
| — | Ser | D-Cys | Cys | Glu | Ile | D-Cys | Cys | Thr | Pro | Ala | Cys | Thr | Gly | D-Cys | Tyr |
| — | Ser | D-Cys | Cys | Glu | Leu | Cys | Cys | Asn | Pro | Ala | Cys | Thr | Gly | Cys | — |
| — | Ser | D-Cys | Cys | Glu | Leu | Cys | Cys | Asn | Pro | Ala | Cys | Thr | Gly | Cys | Lys |
| — | Ser | D-Cys | Cys | Glu | Leu | Cys | Cys | Asn | Pro | Ala | Cys | Thr | Gly | Cys | Tyr |
| — | Ser | D-Cys | Cys | Glu | Leu | Cys | Cys | Asn | Pro | Ala | Cys | Thr | Gly | D-Cys | — |
| — | Ser | D-Cys | Cys | Glu | Leu | Cys | Cys | Asn | Pro | Ala | Cys | Thr | Gly | D-Cys | Lys |
| — | Ser | D-Cys | Cys | Glu | Leu | Cys | Cys | Asn | Pro | Ala | Cys | Thr | Gly | D-Cys | Tyr |
| — | Ser | D-Cys | Cys | Glu | Leu | Cys | Cys | Thr | Pro | Ala | Cys | Thr | Gly | Cys | — |
| — | Ser | D-Cys | Cys | Glu | Leu | Cys | Cys | Thr | Pro | Ala | Cys | Thr | Gly | Cys | Lys |
| — | Ser | D-Cys | Cys | Glu | Leu | Cys | Cys | Thr | Pro | Ala | Cys | Thr | Gly | Cys | Tyr |
| — | Ser | D-Cys | Cys | Glu | Leu | Cys | Cys | Thr | Pro | Ala | Cys | Thr | Gly | D-Cys | — |
| — | Ser | D-Cys | Cys | Glu | Leu | Cys | Cys | Thr | Pro | Ala | Cys | Thr | Gly | D-Cys | Lys |
| — | Ser | D-Cys | Cys | Glu | Leu | Cys | Cys | Thr | Pro | Ala | Cys | Thr | Gly | D-Cys | Tyr |
| — | Ser | D-Cys | Cys | Glu | Leu | D-Cys | Cys | Asn | Pro | Ala | Cys | Thr | Gly | Cys | — |
| — | Ser | D-Cys | Cys | Glu | Leu | D-Cys | Cys | Asn | Pro | Ala | Cys | Thr | Gly | Cys | Lys |
| — | Ser | D-Cys | Cys | Glu | Leu | D-Cys | Cys | Asn | Pro | Ala | Cys | Thr | Gly | Cys | Tyr |
| — | Ser | D-Cys | Cys | Glu | Leu | D-Cys | Cys | Asn | Pro | Ala | Cys | Thr | Gly | D-Cys | — |
| — | Ser | D-Cys | Cys | Glu | Leu | D-Cys | Cys | Asn | Pro | Ala | Cys | Thr | Gly | D-Cys | Lys |
| — | Ser | D-Cys | Cys | Glu | Leu | D-Cys | Cys | Asn | Pro | Ala | Cys | Thr | Gly | D-Cys | Tyr |
| — | Ser | D-Cys | Cys | Glu | Leu | D-Cys | Cys | Thr | Pro | Ala | Cys | Thr | Gly | Cys | — |
| — | Ser | D-Cys | Cys | Glu | Leu | D-Cys | Cys | Thr | Pro | Ala | Cys | Thr | Gly | Cys | Lys |
| — | Ser | D-Cys | Cys | Glu | Leu | D-Cys | Cys | Thr | Pro | Ala | Cys | Thr | Gly | Cys | Tyr |
| — | Ser | D-Cys | Cys | Glu | Leu | D-Cys | Cys | Thr | Pro | Ala | Cys | Thr | Gly | D-Cys | — |
| — | Ser | D-Cys | Cys | Glu | Leu | D-Cys | Cys | Thr | Pro | Ala | Cys | Thr | Gly | D-Cys | Lys |
| — | Ser | D-Cys | Cys | Glu | Leu | D-Cys | Cys | Thr | Pro | Ala | Cys | Thr | Gly | D-Cys | Tyr |
| — | Ser | D-Cys | Cys | Glu | Tyr | Cys | Cys | Asn | Pro | Ala | Cys | Thr | Gly | Cys | — |
| — | Ser | D-Cys | Cys | Glu | Tyr | Cys | Cys | Asn | Pro | Ala | Cys | Thr | Gly | Cys | Lys |
| — | Ser | D-Cys | Cys | Glu | Tyr | Cys | Cys | Asn | Pro | Ala | Cys | Thr | Gly | Cys | Tyr |
| — | Ser | D-Cys | Cys | Glu | Tyr | Cys | Cys | Asn | Pro | Ala | Cys | Thr | Gly | D-Cys | — |
| — | Ser | D-Cys | Cys | Glu | Tyr | Cys | Cys | Asn | Pro | Ala | Cys | Thr | Gly | D-Cys | Lys |
| — | Ser | D-Cys | Cys | Glu | Tyr | Cys | Cys | Asn | Pro | Ala | Cys | Thr | Gly | D-Cys | Tyr |
| — | Ser | D-Cys | Cys | Glu | Tyr | Cys | Cys | Thr | Pro | Ala | Cys | Thr | Gly | Cys | — |
| — | Ser | D-Cys | Cys | Glu | Tyr | Cys | Cys | Thr | Pro | Ala | Cys | Thr | Gly | Cys | Lys |
| — | Ser | D-Cys | Cys | Glu | Tyr | Cys | Cys | Thr | Pro | Ala | Cys | Thr | Gly | Cys | Tyr |
| — | Ser | D-Cys | Cys | Glu | Tyr | Cys | Cys | Thr | Pro | Ala | Cys | Thr | Gly | D-Cys | — |
| — | Ser | D-Cys | Cys | Glu | Tyr | Cys | Cys | Thr | Pro | Ala | Cys | Thr | Gly | D-Cys | Lys |
| — | Ser | D-Cys | Cys | Glu | Tyr | Cys | Cys | Thr | Pro | Ala | Cys | Thr | Gly | D-Cys | Tyr |
| — | Ser | D-Cys | Cys | Glu | Tyr | D-Cys | Cys | Asn | Pro | Ala | Cys | Thr | Gly | Cys | — |
| — | Ser | D-Cys | Cys | Glu | Tyr | D-Cys | Cys | Asn | Pro | Ala | Cys | Thr | Gly | Cys | Lys |
| — | Ser | D-Cys | Cys | Glu | Tyr | D-Cys | Cys | Asn | Pro | Ala | Cys | Thr | Gly | Cys | Tyr |

FIG. 3A-23

| | | | | | | | | | | | | | | |
|---|---|---|---|---|---|---|---|---|---|---|---|---|---|---|
| — | Ser | D-Cys | Cys | Glu | Tyr | D-Cys | Cys | Asn | Pro | Ala | Cys | Thr | Gly | D-Cys | — |
| — | Ser | D-Cys | Cys | Glu | Tyr | D-Cys | Cys | Asn | Pro | Ala | Cys | Thr | Gly | D-Cys | Lys |
| — | Ser | D-Cys | Cys | Glu | Tyr | D-Cys | Cys | Asn | Pro | Ala | Cys | Thr | Gly | D-Cys | Tyr |
| — | Ser | D-Cys | Cys | Glu | Tyr | D-Cys | Cys | Thr | Pro | Ala | Cys | Thr | Gly | Cys | — |
| — | Ser | D-Cys | Cys | Glu | Tyr | D-Cys | Cys | Thr | Pro | Ala | Cys | Thr | Gly | Cys | Lys |
| — | Ser | D-Cys | Cys | Glu | Tyr | D-Cys | Cys | Thr | Pro | Ala | Cys | Thr | Gly | Cys | Tyr |
| — | Ser | D-Cys | Cys | Glu | Tyr | D-Cys | Cys | Thr | Pro | Ala | Cys | Thr | Gly | D-Cys | — |
| — | Ser | D-Cys | Cys | Glu | Tyr | D-Cys | Cys | Thr | Pro | Ala | Cys | Thr | Gly | D-Cys | Lys |
| — | Ser | D-Cys | Cys | Glu | Tyr | D-Cys | Cys | Thr | Pro | Ala | Cys | Thr | Gly | D-Cys | Tyr |
| — | Ser | D-Cys | Cys | Glu | Phe | Cys | Cys | Asn | Pro | Ala | Cys | Thr | Gly | Cys | — |
| — | Ser | D-Cys | Cys | Glu | Phe | Cys | Cys | Asn | Pro | Ala | Cys | Thr | Gly | Cys | Lys |
| — | Ser | D-Cys | Cys | Glu | Phe | Cys | Cys | Asn | Pro | Ala | Cys | Thr | Gly | Cys | Tyr |
| — | Ser | D-Cys | Cys | Glu | Phe | Cys | Cys | Asn | Pro | Ala | Cys | Thr | Gly | D-Cys | — |
| — | Ser | D-Cys | Cys | Glu | Phe | Cys | Cys | Asn | Pro | Ala | Cys | Thr | Gly | D-Cys | Lys |
| — | Ser | D-Cys | Cys | Glu | Phe | Cys | Cys | Asn | Pro | Ala | Cys | Thr | Gly | D-Cys | Tyr |
| — | Ser | D-Cys | Cys | Glu | Phe | Cys | Cys | Thr | Pro | Ala | Cys | Thr | Gly | Cys | — |
| — | Ser | D-Cys | Cys | Glu | Phe | Cys | Cys | Thr | Pro | Ala | Cys | Thr | Gly | Cys | Lys |
| — | Ser | D-Cys | Cys | Glu | Phe | Cys | Cys | Thr | Pro | Ala | Cys | Thr | Gly | Cys | Tyr |
| — | Ser | D-Cys | Cys | Glu | Phe | Cys | Cys | Thr | Pro | Ala | Cys | Thr | Gly | D-Cys | — |
| — | Ser | D-Cys | Cys | Glu | Phe | Cys | Cys | Thr | Pro | Ala | Cys | Thr | Gly | D-Cys | Lys |
| — | Ser | D-Cys | Cys | Glu | Phe | Cys | Cys | Thr | Pro | Ala | Cys | Thr | Gly | D-Cys | Tyr |
| — | Ser | D-Cys | Cys | Glu | Phe | D-Cys | Cys | Asn | Pro | Ala | Cys | Thr | Gly | Cys | — |
| — | Ser | D-Cys | Cys | Glu | Phe | D-Cys | Cys | Asn | Pro | Ala | Cys | Thr | Gly | Cys | Lys |
| — | Ser | D-Cys | Cys | Glu | Phe | D-Cys | Cys | Asn | Pro | Ala | Cys | Thr | Gly | Cys | Tyr |
| — | Ser | D-Cys | Cys | Glu | Phe | D-Cys | Cys | Asn | Pro | Ala | Cys | Thr | Gly | D-Cys | — |
| — | Ser | D-Cys | Cys | Glu | Phe | D-Cys | Cys | Asn | Pro | Ala | Cys | Thr | Gly | D-Cys | Lys |
| — | Ser | D-Cys | Cys | Glu | Phe | D-Cys | Cys | Asn | Pro | Ala | Cys | Thr | Gly | D-Cys | Tyr |
| — | Ser | D-Cys | Cys | Glu | Phe | D-Cys | Cys | Thr | Pro | Ala | Cys | Thr | Gly | Cys | — |
| — | Ser | D-Cys | Cys | Glu | Phe | D-Cys | Cys | Thr | Pro | Ala | Cys | Thr | Gly | Cys | Lys |
| — | Ser | D-Cys | Cys | Glu | Phe | D-Cys | Cys | Thr | Pro | Ala | Cys | Thr | Gly | Cys | Tyr |
| — | Ser | D-Cys | Cys | Glu | Phe | D-Cys | Cys | Thr | Pro | Ala | Cys | Thr | Gly | D-Cys | — |
| — | Ser | D-Cys | Cys | Glu | Phe | D-Cys | Cys | Thr | Pro | Ala | Cys | Thr | Gly | D-Cys | Lys |
| — | Ser | D-Cys | Cys | Glu | Phe | D-Cys | Cys | Thr | Pro | Ala | Cys | Thr | Gly | D-Cys | Tyr |
| — | Ser | D-Cys | Cys | Glu | Trp | Cys | Cys | Asn | Pro | Ala | Cys | Thr | Gly | Cys | — |
| — | Ser | D-Cys | Cys | Glu | Trp | Cys | Cys | Asn | Pro | Ala | Cys | Thr | Gly | Cys | Lys |
| — | Ser | D-Cys | Cys | Glu | Trp | Cys | Cys | Asn | Pro | Ala | Cys | Thr | Gly | Cys | Tyr |
| — | Ser | D-Cys | Cys | Glu | Trp | Cys | Cys | Asn | Pro | Ala | Cys | Thr | Gly | D-Cys | — |
| — | Ser | D-Cys | Cys | Glu | Trp | Cys | Cys | Asn | Pro | Ala | Cys | Thr | Gly | D-Cys | Lys |
| — | Ser | D-Cys | Cys | Glu | Trp | Cys | Cys | Asn | Pro | Ala | Cys | Thr | Gly | D-Cys | Tyr |
| — | Ser | D-Cys | Cys | Glu | Trp | Cys | Cys | Thr | Pro | Ala | Cys | Thr | Gly | Cys | — |
| — | Ser | D-Cys | Cys | Glu | Trp | Cys | Cys | Thr | Pro | Ala | Cys | Thr | Gly | Cys | Lys |
| — | Ser | D-Cys | Cys | Glu | Trp | Cys | Cys | Thr | Pro | Ala | Cys | Thr | Gly | Cys | Tyr |
| — | Ser | D-Cys | Cys | Glu | Trp | Cys | Cys | Thr | Pro | Ala | Cys | Thr | Gly | D-Cys | — |
| — | Ser | D-Cys | Cys | Glu | Trp | Cys | Cys | Thr | Pro | Ala | Cys | Thr | Gly | D-Cys | Lys |
| — | Ser | D-Cys | Cys | Glu | Trp | Cys | Cys | Thr | Pro | Ala | Cys | Thr | Gly | D-Cys | Tyr |
| — | Ser | D-Cys | Cys | Glu | Trp | D-Cys | Cys | Asn | Pro | Ala | Cys | Thr | Gly | Cys | — |
| — | Ser | D-Cys | Cys | Glu | Trp | D-Cys | Cys | Asn | Pro | Ala | Cys | Thr | Gly | Cys | Lys |
| — | Ser | D-Cys | Cys | Glu | Trp | D-Cys | Cys | Asn | Pro | Ala | Cys | Thr | Gly | Cys | Tyr |
| — | Ser | D-Cys | Cys | Glu | Trp | D-Cys | Cys | Asn | Pro | Ala | Cys | Thr | Gly | D-Cys | — |
| — | Ser | D-Cys | Cys | Glu | Trp | D-Cys | Cys | Asn | Pro | Ala | Cys | Thr | Gly | D-Cys | Lys |
| — | Ser | D-Cys | Cys | Glu | Trp | D-Cys | Cys | Asn | Pro | Ala | Cys | Thr | Gly | D-Cys | Tyr |
| — | Ser | D-Cys | Cys | Glu | Trp | D-Cys | Cys | Thr | Pro | Ala | Cys | Thr | Gly | Cys | — |
| — | Ser | D-Cys | Cys | Glu | Trp | D-Cys | Cys | Thr | Pro | Ala | Cys | Thr | Gly | Cys | Lys |
| — | Ser | D-Cys | Cys | Glu | Trp | D-Cys | Cys | Thr | Pro | Ala | Cys | Thr | Gly | Cys | Tyr |
| — | Ser | D-Cys | Cys | Glu | Trp | D-Cys | Cys | Thr | Pro | Ala | Cys | Thr | Gly | D-Cys | — |
| — | Ser | D-Cys | Cys | Glu | Trp | D-Cys | Cys | Thr | Pro | Ala | Cys | Thr | Gly | D-Cys | Lys |
| — | Ser | D-Cys | Cys | Glu | Trp | D-Cys | Cys | Thr | Pro | Ala | Cys | Thr | Gly | D-Cys | Tyr |
| — | Val | Cys | Cys | Glu | Val | Cys | Cys | Asn | Pro | Ala | Cys | Thr | Gly | Cys | — |
| — | Val | Cys | Cys | Glu | Val | Cys | Cys | Asn | Pro | Ala | Cys | Thr | Gly | Cys | Lys |
| — | Val | Cys | Cys | Glu | Val | Cys | Cys | Asn | Pro | Ala | Cys | Thr | Gly | Cys | Tyr |

FIG. 3A-24

| — | Val | Cys | Cys | Glu | Val | Cys | Cys | Asn | Pro | Ala | Cys | Thr | Gly | D-Cys | — |
|---|---|---|---|---|---|---|---|---|---|---|---|---|---|---|---|
| — | Val | Cys | Cys | Glu | Val | Cys | Cys | Asn | Pro | Ala | Cys | Thr | Gly | D-Cys | Lys |
| — | Val | Cys | Cys | Glu | Val | Cys | Cys | Asn | Pro | Ala | Cys | Thr | Gly | D-Cys | Tyr |
| — | Val | Cys | Cys | Glu | Val | Cys | Cys | Thr | Pro | Ala | Cys | Thr | Gly | Cys | — |
| — | Val | Cys | Cys | Glu | Val | Cys | Cys | Thr | Pro | Ala | Cys | Thr | Gly | Cys | Lys |
| — | Val | Cys | Cys | Glu | Val | Cys | Cys | Thr | Pro | Ala | Cys | Thr | Gly | Cys | Tyr |
| — | Val | Cys | Cys | Glu | Val | Cys | Cys | Thr | Pro | Ala | Cys | Thr | Gly | D-Cys | — |
| — | Val | Cys | Cys | Glu | Val | Cys | Cys | Thr | Pro | Ala | Cys | Thr | Gly | D-Cys | Lys |
| — | Val | Cys | Cys | Glu | Val | Cys | Cys | Thr | Pro | Ala | Cys | Thr | Gly | D-Cys | Tyr |
| — | Val | Cys | Cys | Glu | Val | D-Cys | Cys | Asn | Pro | Ala | Cys | Thr | Gly | Cys | — |
| — | Val | Cys | Cys | Glu | Val | D-Cys | Cys | Asn | Pro | Ala | Cys | Thr | Gly | Cys | Lys |
| — | Val | Cys | Cys | Glu | Val | D-Cys | Cys | Asn | Pro | Ala | Cys | Thr | Gly | Cys | Tyr |
| — | Val | Cys | Cys | Glu | Val | D-Cys | Cys | Asn | Pro | Ala | Cys | Thr | Gly | D-Cys | — |
| — | Val | Cys | Cys | Glu | Val | D-Cys | Cys | Asn | Pro | Ala | Cys | Thr | Gly | D-Cys | Lys |
| — | Val | Cys | Cys | Glu | Val | D-Cys | Cys | Asn | Pro | Ala | Cys | Thr | Gly | D-Cys | Tyr |
| — | Val | Cys | Cys | Glu | Val | D-Cys | Cys | Thr | Pro | Ala | Cys | Thr | Gly | Cys | — |
| — | Val | Cys | Cys | Glu | Val | D-Cys | Cys | Thr | Pro | Ala | Cys | Thr | Gly | Cys | Lys |
| — | Val | Cys | Cys | Glu | Val | D-Cys | Cys | Thr | Pro | Ala | Cys | Thr | Gly | Cys | Tyr |
| — | Val | Cys | Cys | Glu | Val | D-Cys | Cys | Thr | Pro | Ala | Cys | Thr | Gly | D-Cys | — |
| — | Val | Cys | Cys | Glu | Val | D-Cys | Cys | Thr | Pro | Ala | Cys | Thr | Gly | D-Cys | Lys |
| — | Val | Cys | Cys | Glu | Val | D-Cys | Cys | Thr | Pro | Ala | Cys | Thr | Gly | D-Cys | Tyr |
| — | Val | Cys | Cys | Glu | Ile | Cys | Cys | Asn | Pro | Ala | Cys | Thr | Gly | Cys | — |
| — | Val | Cys | Cys | Glu | Ile | Cys | Cys | Asn | Pro | Ala | Cys | Thr | Gly | Cys | Lys |
| — | Val | Cys | Cys | Glu | Ile | Cys | Cys | Asn | Pro | Ala | Cys | Thr | Gly | Cys | Tyr |
| — | Val | Cys | Cys | Glu | Ile | Cys | Cys | Asn | Pro | Ala | Cys | Thr | Gly | D-Cys | — |
| — | Val | Cys | Cys | Glu | Ile | Cys | Cys | Asn | Pro | Ala | Cys | Thr | Gly | D-Cys | Lys |
| — | Val | Cys | Cys | Glu | Ile | Cys | Cys | Asn | Pro | Ala | Cys | Thr | Gly | D-Cys | Tyr |
| — | Val | Cys | Cys | Glu | Ile | Cys | Cys | Thr | Pro | Ala | Cys | Thr | Gly | Cys | — |
| — | Val | Cys | Cys | Glu | Ile | Cys | Cys | Thr | Pro | Ala | Cys | Thr | Gly | Cys | Lys |
| — | Val | Cys | Cys | Glu | Ile | Cys | Cys | Thr | Pro | Ala | Cys | Thr | Gly | Cys | Tyr |
| — | Val | Cys | Cys | Glu | Ile | Cys | Cys | Thr | Pro | Ala | Cys | Thr | Gly | D-Cys | — |
| — | Val | Cys | Cys | Glu | Ile | Cys | Cys | Thr | Pro | Ala | Cys | Thr | Gly | D-Cys | Lys |
| — | Val | Cys | Cys | Glu | Ile | Cys | Cys | Thr | Pro | Ala | Cys | Thr | Gly | D-Cys | Tyr |
| — | Val | Cys | Cys | Glu | Ile | D-Cys | Cys | Asn | Pro | Ala | Cys | Thr | Gly | Cys | — |
| — | Val | Cys | Cys | Glu | Ile | D-Cys | Cys | Asn | Pro | Ala | Cys | Thr | Gly | Cys | Lys |
| — | Val | Cys | Cys | Glu | Ile | D-Cys | Cys | Asn | Pro | Ala | Cys | Thr | Gly | Cys | Tyr |
| — | Val | Cys | Cys | Glu | Ile | D-Cys | Cys | Asn | Pro | Ala | Cys | Thr | Gly | D-Cys | — |
| — | Val | Cys | Cys | Glu | Ile | D-Cys | Cys | Asn | Pro | Ala | Cys | Thr | Gly | D-Cys | Lys |
| — | Val | Cys | Cys | Glu | Ile | D-Cys | Cys | Asn | Pro | Ala | Cys | Thr | Gly | D-Cys | Tyr |
| — | Val | Cys | Cys | Glu | Ile | D-Cys | Cys | Thr | Pro | Ala | Cys | Thr | Gly | Cys | — |
| — | Val | Cys | Cys | Glu | Ile | D-Cys | Cys | Thr | Pro | Ala | Cys | Thr | Gly | Cys | Lys |
| — | Val | Cys | Cys | Glu | Ile | D-Cys | Cys | Thr | Pro | Ala | Cys | Thr | Gly | Cys | Tyr |
| — | Val | Cys | Cys | Glu | Ile | D-Cys | Cys | Thr | Pro | Ala | Cys | Thr | Gly | D-Cys | — |
| — | Val | Cys | Cys | Glu | Ile | D-Cys | Cys | Thr | Pro | Ala | Cys | Thr | Gly | D-Cys | Lys |
| — | Val | Cys | Cys | Glu | Ile | D-Cys | Cys | Thr | Pro | Ala | Cys | Thr | Gly | D-Cys | Tyr |
| — | Val | Cys | Cys | Glu | Leu | Cys | Cys | Asn | Pro | Ala | Cys | Thr | Gly | Cys | — |
| — | Val | Cys | Cys | Glu | Leu | Cys | Cys | Asn | Pro | Ala | Cys | Thr | Gly | Cys | Lys |
| — | Val | Cys | Cys | Glu | Leu | Cys | Cys | Asn | Pro | Ala | Cys | Thr | Gly | Cys | Tyr |
| — | Val | Cys | Cys | Glu | Leu | Cys | Cys | Asn | Pro | Ala | Cys | Thr | Gly | D-Cys | — |
| — | Val | Cys | Cys | Glu | Leu | Cys | Cys | Asn | Pro | Ala | Cys | Thr | Gly | D-Cys | Lys |
| — | Val | Cys | Cys | Glu | Leu | Cys | Cys | Asn | Pro | Ala | Cys | Thr | Gly | D-Cys | Tyr |
| — | Val | Cys | Cys | Glu | Leu | Cys | Cys | Thr | Pro | Ala | Cys | Thr | Gly | Cys | — |
| — | Val | Cys | Cys | Glu | Leu | Cys | Cys | Thr | Pro | Ala | Cys | Thr | Gly | Cys | Lys |
| — | Val | Cys | Cys | Glu | Leu | Cys | Cys | Thr | Pro | Ala | Cys | Thr | Gly | Cys | Tyr |
| — | Val | Cys | Cys | Glu | Leu | Cys | Cys | Thr | Pro | Ala | Cys | Thr | Gly | D-Cys | — |
| — | Val | Cys | Cys | Glu | Leu | Cys | Cys | Thr | Pro | Ala | Cys | Thr | Gly | D-Cys | Lys |
| — | Val | Cys | Cys | Glu | Leu | Cys | Cys | Thr | Pro | Ala | Cys | Thr | Gly | D-Cys | Tyr |
| — | Val | Cys | Cys | Glu | Leu | D-Cys | Cys | Asn | Pro | Ala | Cys | Thr | Gly | Cys | — |
| — | Val | Cys | Cys | Glu | Leu | D-Cys | Cys | Asn | Pro | Ala | Cys | Thr | Gly | Cys | Lys |
| — | Val | Cys | Cys | Glu | Leu | D-Cys | Cys | Asn | Pro | Ala | Cys | Thr | Gly | Cys | Tyr |

FIG. 3A-25

| | | | | | | | | | | | | | |
|---|---|---|---|---|---|---|---|---|---|---|---|---|---|
| — | Val | Cys | Cys | Glu | Leu | D-Cys | Cys | Asn | Pro | Ala | Cys | Thr | Gly | D-Cys | — |
| — | Val | Cys | Cys | Glu | Leu | D-Cys | Cys | Asn | Pro | Ala | Cys | Thr | Gly | D-Cys | Lys |
| — | Val | Cys | Cys | Glu | Leu | D-Cys | Cys | Asn | Pro | Ala | Cys | Thr | Gly | D-Cys | Tyr |
| — | Val | Cys | Cys | Glu | Leu | D-Cys | Cys | Thr | Pro | Ala | Cys | Thr | Gly | Cys | — |
| — | Val | Cys | Cys | Glu | Leu | D-Cys | Cys | Thr | Pro | Ala | Cys | Thr | Gly | Cys | Lys |
| — | Val | Cys | Cys | Glu | Leu | D-Cys | Cys | Thr | Pro | Ala | Cys | Thr | Gly | Cys | Tyr |
| — | Val | Cys | Cys | Glu | Leu | D-Cys | Cys | Thr | Pro | Ala | Cys | Thr | Gly | D-Cys | — |
| — | Val | Cys | Cys | Glu | Leu | D-Cys | Cys | Thr | Pro | Ala | Cys | Thr | Gly | D-Cys | Lys |
| — | Val | Cys | Cys | Glu | Leu | D-Cys | Cys | Thr | Pro | Ala | Cys | Thr | Gly | D-Cys | Tyr |
| — | Val | Cys | Cys | Glu | Tyr | Cys | Cys | Asn | Pro | Ala | Cys | Thr | Gly | Cys | — |
| — | Val | Cys | Cys | Glu | Tyr | Cys | Cys | Asn | Pro | Ala | Cys | Thr | Gly | Cys | Lys |
| — | Val | Cys | Cys | Glu | Tyr | Cys | Cys | Asn | Pro | Ala | Cys | Thr | Gly | Cys | Tyr |
| — | Val | Cys | Cys | Glu | Tyr | Cys | Cys | Asn | Pro | Ala | Cys | Thr | Gly | D-Cys | — |
| — | Val | Cys | Cys | Glu | Tyr | Cys | Cys | Asn | Pro | Ala | Cys | Thr | Gly | D-Cys | Lys |
| — | Val | Cys | Cys | Glu | Tyr | Cys | Cys | Asn | Pro | Ala | Cys | Thr | Gly | D-Cys | Tyr |
| — | Val | Cys | Cys | Glu | Tyr | Cys | Cys | Thr | Pro | Ala | Cys | Thr | Gly | Cys | — |
| — | Val | Cys | Cys | Glu | Tyr | Cys | Cys | Thr | Pro | Ala | Cys | Thr | Gly | Cys | Lys |
| — | Val | Cys | Cys | Glu | Tyr | Cys | Cys | Thr | Pro | Ala | Cys | Thr | Gly | Cys | Tyr |
| — | Val | Cys | Cys | Glu | Tyr | Cys | Cys | Thr | Pro | Ala | Cys | Thr | Gly | D-Cys | — |
| — | Val | Cys | Cys | Glu | Tyr | Cys | Cys | Thr | Pro | Ala | Cys | Thr | Gly | D-Cys | Lys |
| — | Val | Cys | Cys | Glu | Tyr | Cys | Cys | Thr | Pro | Ala | Cys | Thr | Gly | D-Cys | Tyr |
| — | Val | Cys | Cys | Glu | Tyr | D-Cys | Cys | Asn | Pro | Ala | Cys | Thr | Gly | Cys | — |
| — | Val | Cys | Cys | Glu | Tyr | D-Cys | Cys | Asn | Pro | Ala | Cys | Thr | Gly | Cys | Lys |
| — | Val | Cys | Cys | Glu | Tyr | D-Cys | Cys | Asn | Pro | Ala | Cys | Thr | Gly | Cys | Tyr |
| — | Val | Cys | Cys | Glu | Tyr | D-Cys | Cys | Asn | Pro | Ala | Cys | Thr | Gly | D-Cys | — |
| — | Val | Cys | Cys | Glu | Tyr | D-Cys | Cys | Asn | Pro | Ala | Cys | Thr | Gly | D-Cys | Lys |
| — | Val | Cys | Cys | Glu | Tyr | D-Cys | Cys | Asn | Pro | Ala | Cys | Thr | Gly | D-Cys | Tyr |
| — | Val | Cys | Cys | Glu | Tyr | D-Cys | Cys | Thr | Pro | Ala | Cys | Thr | Gly | Cys | — |
| — | Val | Cys | Cys | Glu | Tyr | D-Cys | Cys | Thr | Pro | Ala | Cys | Thr | Gly | Cys | Lys |
| — | Val | Cys | Cys | Glu | Tyr | D-Cys | Cys | Thr | Pro | Ala | Cys | Thr | Gly | Cys | Tyr |
| — | Val | Cys | Cys | Glu | Tyr | D-Cys | Cys | Thr | Pro | Ala | Cys | Thr | Gly | D-Cys | — |
| — | Val | Cys | Cys | Glu | Tyr | D-Cys | Cys | Thr | Pro | Ala | Cys | Thr | Gly | D-Cys | Lys |
| — | Val | Cys | Cys | Glu | Tyr | D-Cys | Cys | Thr | Pro | Ala | Cys | Thr | Gly | D-Cys | Tyr |
| — | Val | Cys | Cys | Glu | Phe | Cys | Cys | Asn | Pro | Ala | Cys | Thr | Gly | Cys | — |
| — | Val | Cys | Cys | Glu | Phe | Cys | Cys | Asn | Pro | Ala | Cys | Thr | Gly | Cys | Lys |
| — | Val | Cys | Cys | Glu | Phe | Cys | Cys | Asn | Pro | Ala | Cys | Thr | Gly | Cys | Tyr |
| — | Val | Cys | Cys | Glu | Phe | Cys | Cys | Asn | Pro | Ala | Cys | Thr | Gly | D-Cys | — |
| — | Val | Cys | Cys | Glu | Phe | Cys | Cys | Asn | Pro | Ala | Cys | Thr | Gly | D-Cys | Lys |
| — | Val | Cys | Cys | Glu | Phe | Cys | Cys | Asn | Pro | Ala | Cys | Thr | Gly | D-Cys | Tyr |
| — | Val | Cys | Cys | Glu | Phe | Cys | Cys | Thr | Pro | Ala | Cys | Thr | Gly | Cys | — |
| — | Val | Cys | Cys | Glu | Phe | Cys | Cys | Thr | Pro | Ala | Cys | Thr | Gly | Cys | Lys |
| — | Val | Cys | Cys | Glu | Phe | Cys | Cys | Thr | Pro | Ala | Cys | Thr | Gly | Cys | Tyr |
| — | Val | Cys | Cys | Glu | Phe | Cys | Cys | Thr | Pro | Ala | Cys | Thr | Gly | D-Cys | — |
| — | Val | Cys | Cys | Glu | Phe | Cys | Cys | Thr | Pro | Ala | Cys | Thr | Gly | D-Cys | Lys |
| — | Val | Cys | Cys | Glu | Phe | Cys | Cys | Thr | Pro | Ala | Cys | Thr | Gly | D-Cys | Tyr |
| — | Val | Cys | Cys | Glu | Phe | D-Cys | Cys | Asn | Pro | Ala | Cys | Thr | Gly | Cys | — |
| — | Val | Cys | Cys | Glu | Phe | D-Cys | Cys | Asn | Pro | Ala | Cys | Thr | Gly | Cys | Lys |
| — | Val | Cys | Cys | Glu | Phe | D-Cys | Cys | Asn | Pro | Ala | Cys | Thr | Gly | Cys | Tyr |
| — | Val | Cys | Cys | Glu | Phe | D-Cys | Cys | Asn | Pro | Ala | Cys | Thr | Gly | D-Cys | — |
| — | Val | Cys | Cys | Glu | Phe | D-Cys | Cys | Asn | Pro | Ala | Cys | Thr | Gly | D-Cys | Lys |
| — | Val | Cys | Cys | Glu | Phe | D-Cys | Cys | Asn | Pro | Ala | Cys | Thr | Gly | D-Cys | Tyr |
| — | Val | Cys | Cys | Glu | Phe | D-Cys | Cys | Thr | Pro | Ala | Cys | Thr | Gly | Cys | — |
| — | Val | Cys | Cys | Glu | Phe | D-Cys | Cys | Thr | Pro | Ala | Cys | Thr | Gly | Cys | Lys |
| — | Val | Cys | Cys | Glu | Phe | D-Cys | Cys | Thr | Pro | Ala | Cys | Thr | Gly | Cys | Tyr |
| — | Val | Cys | Cys | Glu | Phe | D-Cys | Cys | Thr | Pro | Ala | Cys | Thr | Gly | D-Cys | — |
| — | Val | Cys | Cys | Glu | Phe | D-Cys | Cys | Thr | Pro | Ala | Cys | Thr | Gly | D-Cys | Lys |
| — | Val | Cys | Cys | Glu | Phe | D-Cys | Cys | Thr | Pro | Ala | Cys | Thr | Gly | D-Cys | Tyr |
| — | Val | Cys | Cys | Glu | Trp | Cys | Cys | Asn | Pro | Ala | Cys | Thr | Gly | Cys | — |
| — | Val | Cys | Cys | Glu | Trp | Cys | Cys | Asn | Pro | Ala | Cys | Thr | Gly | Cys | Lys |
| — | Val | Cys | Cys | Glu | Trp | Cys | Cys | Asn | Pro | Ala | Cys | Thr | Gly | Cys | Tyr |

FIG. 3A-26

| | | | | | | | | | | | | | | |
|---|---|---|---|---|---|---|---|---|---|---|---|---|---|---|
| --- | Val | Cys | Cys | Glu | Trp | Cys | Cys | Asn | Pro | Ala | Cys | Thr | Gly | D-Cys | --- |
| --- | Val | Cys | Cys | Glu | Trp | Cys | Cys | Asn | Pro | Ala | Cys | Thr | Gly | D-Cys | Lys |
| --- | Val | Cys | Cys | Glu | Trp | Cys | Cys | Asn | Pro | Ala | Cys | Thr | Gly | D-Cys | Tyr |
| --- | Val | Cys | Cys | Glu | Trp | Cys | Cys | Thr | Pro | Ala | Cys | Thr | Gly | Cys | --- |
| --- | Val | Cys | Cys | Glu | Trp | Cys | Cys | Thr | Pro | Ala | Cys | Thr | Gly | Cys | Lys |
| --- | Val | Cys | Cys | Glu | Trp | Cys | Cys | Thr | Pro | Ala | Cys | Thr | Gly | Cys | Tyr |
| --- | Val | Cys | Cys | Glu | Trp | Cys | Cys | Thr | Pro | Ala | Cys | Thr | Gly | D-Cys | --- |
| --- | Val | Cys | Cys | Glu | Trp | Cys | Cys | Thr | Pro | Ala | Cys | Thr | Gly | D-Cys | Lys |
| --- | Val | Cys | Cys | Glu | Trp | Cys | Cys | Thr | Pro | Ala | Cys | Thr | Gly | D-Cys | Tyr |
| --- | Val | Cys | Cys | Glu | Trp | D-Cys | Cys | Asn | Pro | Ala | Cys | Thr | Gly | Cys | --- |
| --- | Val | Cys | Cys | Glu | Trp | D-Cys | Cys | Asn | Pro | Ala | Cys | Thr | Gly | Cys | Lys |
| --- | Val | Cys | Cys | Glu | Trp | D-Cys | Cys | Asn | Pro | Ala | Cys | Thr | Gly | Cys | Tyr |
| --- | Val | Cys | Cys | Glu | Trp | D-Cys | Cys | Asn | Pro | Ala | Cys | Thr | Gly | D-Cys | --- |
| --- | Val | Cys | Cys | Glu | Trp | D-Cys | Cys | Asn | Pro | Ala | Cys | Thr | Gly | D-Cys | Lys |
| --- | Val | Cys | Cys | Glu | Trp | D-Cys | Cys | Asn | Pro | Ala | Cys | Thr | Gly | D-Cys | Tyr |
| --- | Val | Cys | Cys | Glu | Trp | D-Cys | Cys | Thr | Pro | Ala | Cys | Thr | Gly | Cys | --- |
| --- | Val | Cys | Cys | Glu | Trp | D-Cys | Cys | Thr | Pro | Ala | Cys | Thr | Gly | Cys | Lys |
| --- | Val | Cys | Cys | Glu | Trp | D-Cys | Cys | Thr | Pro | Ala | Cys | Thr | Gly | Cys | Tyr |
| --- | Val | Cys | Cys | Glu | Trp | D-Cys | Cys | Thr | Pro | Ala | Cys | Thr | Gly | D-Cys | --- |
| --- | Val | Cys | Cys | Glu | Trp | D-Cys | Cys | Thr | Pro | Ala | Cys | Thr | Gly | D-Cys | Lys |
| --- | Val | Cys | Cys | Glu | Trp | D-Cys | Cys | Thr | Pro | Ala | Cys | Thr | Gly | D-Cys | Tyr |
| --- | Val | D-Cys | Cys | Glu | Val | Cys | Cys | Asn | Pro | Ala | Cys | Thr | Gly | Cys | --- |
| --- | Val | D-Cys | Cys | Glu | Val | Cys | Cys | Asn | Pro | Ala | Cys | Thr | Gly | Cys | Lys |
| --- | Val | D-Cys | Cys | Glu | Val | Cys | Cys | Asn | Pro | Ala | Cys | Thr | Gly | Cys | Tyr |
| --- | Val | D-Cys | Cys | Glu | Val | Cys | Cys | Asn | Pro | Ala | Cys | Thr | Gly | D-Cys | --- |
| --- | Val | D-Cys | Cys | Glu | Val | Cys | Cys | Asn | Pro | Ala | Cys | Thr | Gly | D-Cys | Lys |
| --- | Val | D-Cys | Cys | Glu | Val | Cys | Cys | Asn | Pro | Ala | Cys | Thr | Gly | D-Cys | Tyr |
| --- | Val | D-Cys | Cys | Glu | Val | Cys | Cys | Thr | Pro | Ala | Cys | Thr | Gly | Cys | --- |
| --- | Val | D-Cys | Cys | Glu | Val | Cys | Cys | Thr | Pro | Ala | Cys | Thr | Gly | Cys | Lys |
| --- | Val | D-Cys | Cys | Glu | Val | Cys | Cys | Thr | Pro | Ala | Cys | Thr | Gly | Cys | Tyr |
| --- | Val | D-Cys | Cys | Glu | Val | Cys | Cys | Thr | Pro | Ala | Cys | Thr | Gly | D-Cys | --- |
| --- | Val | D-Cys | Cys | Glu | Val | Cys | Cys | Thr | Pro | Ala | Cys | Thr | Gly | D-Cys | Lys |
| --- | Val | D-Cys | Cys | Glu | Val | Cys | Cys | Thr | Pro | Ala | Cys | Thr | Gly | D-Cys | Tyr |
| --- | Val | D-Cys | Cys | Glu | Val | D-Cys | Cys | Asn | Pro | Ala | Cys | Thr | Gly | Cys | --- |
| --- | Val | D-Cys | Cys | Glu | Val | D-Cys | Cys | Asn | Pro | Ala | Cys | Thr | Gly | Cys | Lys |
| --- | Val | D-Cys | Cys | Glu | Val | D-Cys | Cys | Asn | Pro | Ala | Cys | Thr | Gly | Cys | Tyr |
| --- | Val | D-Cys | Cys | Glu | Val | D-Cys | Cys | Asn | Pro | Ala | Cys | Thr | Gly | D-Cys | --- |
| --- | Val | D-Cys | Cys | Glu | Val | D-Cys | Cys | Asn | Pro | Ala | Cys | Thr | Gly | D-Cys | Lys |
| --- | Val | D-Cys | Cys | Glu | Val | D-Cys | Cys | Asn | Pro | Ala | Cys | Thr | Gly | D-Cys | Tyr |
| --- | Val | D-Cys | Cys | Glu | Val | D-Cys | Cys | Thr | Pro | Ala | Cys | Thr | Gly | Cys | --- |
| --- | Val | D-Cys | Cys | Glu | Val | D-Cys | Cys | Thr | Pro | Ala | Cys | Thr | Gly | Cys | Lys |
| --- | Val | D-Cys | Cys | Glu | Val | D-Cys | Cys | Thr | Pro | Ala | Cys | Thr | Gly | Cys | Tyr |
| --- | Val | D-Cys | Cys | Glu | Val | D-Cys | Cys | Thr | Pro | Ala | Cys | Thr | Gly | D-Cys | --- |
| --- | Val | D-Cys | Cys | Glu | Val | D-Cys | Cys | Thr | Pro | Ala | Cys | Thr | Gly | D-Cys | Lys |
| --- | Val | D-Cys | Cys | Glu | Val | D-Cys | Cys | Thr | Pro | Ala | Cys | Thr | Gly | D-Cys | Tyr |
| --- | Val | D-Cys | Cys | Glu | Ile | Cys | Cys | Asn | Pro | Ala | Cys | Thr | Gly | Cys | --- |
| --- | Val | D-Cys | Cys | Glu | Ile | Cys | Cys | Asn | Pro | Ala | Cys | Thr | Gly | Cys | Lys |
| --- | Val | D-Cys | Cys | Glu | Ile | Cys | Cys | Asn | Pro | Ala | Cys | Thr | Gly | Cys | Tyr |
| --- | Val | D-Cys | Cys | Glu | Ile | Cys | Cys | Asn | Pro | Ala | Cys | Thr | Gly | D-Cys | --- |
| --- | Val | D-Cys | Cys | Glu | Ile | Cys | Cys | Asn | Pro | Ala | Cys | Thr | Gly | D-Cys | Lys |
| --- | Val | D-Cys | Cys | Glu | Ile | Cys | Cys | Asn | Pro | Ala | Cys | Thr | Gly | D-Cys | Tyr |
| --- | Val | D-Cys | Cys | Glu | Ile | Cys | Cys | Thr | Pro | Ala | Cys | Thr | Gly | Cys | --- |
| --- | Val | D-Cys | Cys | Glu | Ile | Cys | Cys | Thr | Pro | Ala | Cys | Thr | Gly | Cys | Lys |
| --- | Val | D-Cys | Cys | Glu | Ile | Cys | Cys | Thr | Pro | Ala | Cys | Thr | Gly | Cys | Tyr |
| --- | Val | D-Cys | Cys | Glu | Ile | Cys | Cys | Thr | Pro | Ala | Cys | Thr | Gly | D-Cys | --- |
| --- | Val | D-Cys | Cys | Glu | Ile | Cys | Cys | Thr | Pro | Ala | Cys | Thr | Gly | D-Cys | Lys |
| --- | Val | D-Cys | Cys | Glu | Ile | Cys | Cys | Thr | Pro | Ala | Cys | Thr | Gly | D-Cys | Tyr |
| --- | Val | D-Cys | Cys | Glu | Ile | D-Cys | Cys | Asn | Pro | Ala | Cys | Thr | Gly | Cys | --- |
| --- | Val | D-Cys | Cys | Glu | Ile | D-Cys | Cys | Asn | Pro | Ala | Cys | Thr | Gly | Cys | Lys |
| --- | Val | D-Cys | Cys | Glu | Ile | D-Cys | Cys | Asn | Pro | Ala | Cys | Thr | Gly | Cys | Tyr |

FIG. 3A-27

| | | | | | | | | | | | | | |
|---|---|---|---|---|---|---|---|---|---|---|---|---|---|
| — | Val | D-Cys | Cys | Glu | Ile | D-Cys | Cys | Asn | Pro | Ala | Cys | Thr | Gly | D-Cys | — |
| — | Val | D-Cys | Cys | Glu | Ile | D-Cys | Cys | Asn | Pro | Ala | Cys | Thr | Gly | D-Cys | Lys |
| — | Val | D-Cys | Cys | Glu | Ile | D-Cys | Cys | Asn | Pro | Ala | Cys | Thr | Gly | D-Cys | Tyr |
| — | Val | D-Cys | Cys | Glu | Ile | D-Cys | Cys | Thr | Pro | Ala | Cys | Thr | Gly | Cys | — |
| — | Val | D-Cys | Cys | Glu | Ile | D-Cys | Cys | Thr | Pro | Ala | Cys | Thr | Gly | Cys | Lys |
| — | Val | D-Cys | Cys | Glu | Ile | D-Cys | Cys | Thr | Pro | Ala | Cys | Thr | Gly | Cys | Tyr |
| — | Val | D-Cys | Cys | Glu | Ile | D-Cys | Cys | Thr | Pro | Ala | Cys | Thr | Gly | D-Cys | — |
| — | Val | D-Cys | Cys | Glu | Ile | D-Cys | Cys | Thr | Pro | Ala | Cys | Thr | Gly | D-Cys | Lys |
| — | Val | D-Cys | Cys | Glu | Ile | D-Cys | Cys | Thr | Pro | Ala | Cys | Thr | Gly | D-Cys | Tyr |
| — | Val | D-Cys | Cys | Glu | Leu | Cys | Cys | Asn | Pro | Ala | Cys | Thr | Gly | Cys | — |
| — | Val | D-Cys | Cys | Glu | Leu | Cys | Cys | Asn | Pro | Ala | Cys | Thr | Gly | Cys | Lys |
| — | Val | D-Cys | Cys | Glu | Leu | Cys | Cys | Asn | Pro | Ala | Cys | Thr | Gly | Cys | Tyr |
| — | Val | D-Cys | Cys | Glu | Leu | Cys | Cys | Asn | Pro | Ala | Cys | Thr | Gly | D-Cys | — |
| — | Val | D-Cys | Cys | Glu | Leu | Cys | Cys | Asn | Pro | Ala | Cys | Thr | Gly | D-Cys | Lys |
| — | Val | D-Cys | Cys | Glu | Leu | Cys | Cys | Asn | Pro | Ala | Cys | Thr | Gly | D-Cys | Tyr |
| — | Val | D-Cys | Cys | Glu | Leu | Cys | Cys | Thr | Pro | Ala | Cys | Thr | Gly | Cys | — |
| — | Val | D-Cys | Cys | Glu | Leu | Cys | Cys | Thr | Pro | Ala | Cys | Thr | Gly | Cys | Lys |
| — | Val | D-Cys | Cys | Glu | Leu | Cys | Cys | Thr | Pro | Ala | Cys | Thr | Gly | Cys | Tyr |
| — | Val | D-Cys | Cys | Glu | Leu | Cys | Cys | Thr | Pro | Ala | Cys | Thr | Gly | D-Cys | — |
| — | Val | D-Cys | Cys | Glu | Leu | Cys | Cys | Thr | Pro | Ala | Cys | Thr | Gly | D-Cys | Lys |
| — | Val | D-Cys | Cys | Glu | Leu | Cys | Cys | Thr | Pro | Ala | Cys | Thr | Gly | D-Cys | Tyr |
| — | Val | D-Cys | Cys | Glu | Leu | D-Cys | Cys | Asn | Pro | Ala | Cys | Thr | Gly | Cys | — |
| — | Val | D-Cys | Cys | Glu | Leu | D-Cys | Cys | Asn | Pro | Ala | Cys | Thr | Gly | Cys | Lys |
| — | Val | D-Cys | Cys | Glu | Leu | D-Cys | Cys | Asn | Pro | Ala | Cys | Thr | Gly | Cys | Tyr |
| — | Val | D-Cys | Cys | Glu | Leu | D-Cys | Cys | Asn | Pro | Ala | Cys | Thr | Gly | D-Cys | — |
| — | Val | D-Cys | Cys | Glu | Leu | D-Cys | Cys | Asn | Pro | Ala | Cys | Thr | Gly | D-Cys | Lys |
| — | Val | D-Cys | Cys | Glu | Leu | D-Cys | Cys | Asn | Pro | Ala | Cys | Thr | Gly | D-Cys | Tyr |
| — | Val | D-Cys | Cys | Glu | Leu | D-Cys | Cys | Thr | Pro | Ala | Cys | Thr | Gly | Cys | — |
| — | Val | D-Cys | Cys | Glu | Leu | D-Cys | Cys | Thr | Pro | Ala | Cys | Thr | Gly | Cys | Lys |
| — | Val | D-Cys | Cys | Glu | Leu | D-Cys | Cys | Thr | Pro | Ala | Cys | Thr | Gly | Cys | Tyr |
| — | Val | D-Cys | Cys | Glu | Leu | D-Cys | Cys | Thr | Pro | Ala | Cys | Thr | Gly | D-Cys | — |
| — | Val | D-Cys | Cys | Glu | Leu | D-Cys | Cys | Thr | Pro | Ala | Cys | Thr | Gly | D-Cys | Lys |
| — | Val | D-Cys | Cys | Glu | Leu | D-Cys | Cys | Thr | Pro | Ala | Cys | Thr | Gly | D-Cys | Tyr |
| — | Val | D-Cys | Cys | Glu | Tyr | Cys | Cys | Asn | Pro | Ala | Cys | Thr | Gly | Cys | — |
| — | Val | D-Cys | Cys | Glu | Tyr | Cys | Cys | Asn | Pro | Ala | Cys | Thr | Gly | Cys | Lys |
| — | Val | D-Cys | Cys | Glu | Tyr | Cys | Cys | Asn | Pro | Ala | Cys | Thr | Gly | Cys | Tyr |
| — | Val | D-Cys | Cys | Glu | Tyr | Cys | Cys | Asn | Pro | Ala | Cys | Thr | Gly | D-Cys | — |
| — | Val | D-Cys | Cys | Glu | Tyr | Cys | Cys | Asn | Pro | Ala | Cys | Thr | Gly | D-Cys | Lys |
| — | Val | D-Cys | Cys | Glu | Tyr | Cys | Cys | Asn | Pro | Ala | Cys | Thr | Gly | D-Cys | Tyr |
| — | Val | D-Cys | Cys | Glu | Tyr | Cys | Cys | Thr | Pro | Ala | Cys | Thr | Gly | Cys | — |
| — | Val | D-Cys | Cys | Glu | Tyr | Cys | Cys | Thr | Pro | Ala | Cys | Thr | Gly | Cys | Lys |
| — | Val | D-Cys | Cys | Glu | Tyr | Cys | Cys | Thr | Pro | Ala | Cys | Thr | Gly | Cys | Tyr |
| — | Val | D-Cys | Cys | Glu | Tyr | Cys | Cys | Thr | Pro | Ala | Cys | Thr | Gly | D-Cys | — |
| — | Val | D-Cys | Cys | Glu | Tyr | Cys | Cys | Thr | Pro | Ala | Cys | Thr | Gly | D-Cys | Lys |
| — | Val | D-Cys | Cys | Glu | Tyr | Cys | Cys | Thr | Pro | Ala | Cys | Thr | Gly | D-Cys | Tyr |
| — | Val | D-Cys | Cys | Glu | Tyr | D-Cys | Cys | Asn | Pro | Ala | Cys | Thr | Gly | Cys | — |
| — | Val | D-Cys | Cys | Glu | Tyr | D-Cys | Cys | Asn | Pro | Ala | Cys | Thr | Gly | Cys | Lys |
| — | Val | D-Cys | Cys | Glu | Tyr | D-Cys | Cys | Asn | Pro | Ala | Cys | Thr | Gly | Cys | Tyr |
| — | Val | D-Cys | Cys | Glu | Tyr | D-Cys | Cys | Asn | Pro | Ala | Cys | Thr | Gly | D-Cys | — |
| — | Val | D-Cys | Cys | Glu | Tyr | D-Cys | Cys | Asn | Pro | Ala | Cys | Thr | Gly | D-Cys | Lys |
| — | Val | D-Cys | Cys | Glu | Tyr | D-Cys | Cys | Asn | Pro | Ala | Cys | Thr | Gly | D-Cys | Tyr |
| — | Val | D-Cys | Cys | Glu | Tyr | D-Cys | Cys | Thr | Pro | Ala | Cys | Thr | Gly | Cys | — |
| — | Val | D-Cys | Cys | Glu | Tyr | D-Cys | Cys | Thr | Pro | Ala | Cys | Thr | Gly | Cys | Lys |
| — | Val | D-Cys | Cys | Glu | Tyr | D-Cys | Cys | Thr | Pro | Ala | Cys | Thr | Gly | Cys | Tyr |
| — | Val | D-Cys | Cys | Glu | Tyr | D-Cys | Cys | Thr | Pro | Ala | Cys | Thr | Gly | D-Cys | — |
| — | Val | D-Cys | Cys | Glu | Tyr | D-Cys | Cys | Thr | Pro | Ala | Cys | Thr | Gly | D-Cys | Lys |
| — | Val | D-Cys | Cys | Glu | Tyr | D-Cys | Cys | Thr | Pro | Ala | Cys | Thr | Gly | D-Cys | Tyr |
| — | Val | D-Cys | Cys | Glu | Phe | Cys | Cys | Asn | Pro | Ala | Cys | Thr | Gly | Cys | — |
| — | Val | D-Cys | Cys | Glu | Phe | Cys | Cys | Asn | Pro | Ala | Cys | Thr | Gly | Cys | Lys |
| — | Val | D-Cys | Cys | Glu | Phe | Cys | Cys | Asn | Pro | Ala | Cys | Thr | Gly | Cys | Tyr |

FIG. 3A-28

| | | | | | | | | | | | | | | |
|---|---|---|---|---|---|---|---|---|---|---|---|---|---|---|
| — | Val | D-Cys | Cys | Glu | Phe | Cys | Cys | Asn | Pro | Ala | Cys | Thr | Gly | D-Cys | — |
| — | Val | D-Cys | Cys | Glu | Phe | Cys | Cys | Asn | Pro | Ala | Cys | Thr | Gly | D-Cys | Lys |
| — | Val | D-Cys | Cys | Glu | Phe | Cys | Cys | Asn | Pro | Ala | Cys | Thr | Gly | D-Cys | Tyr |
| — | Val | D-Cys | Cys | Glu | Phe | Cys | Cys | Thr | Pro | Ala | Cys | Thr | Gly | Cys | — |
| — | Val | D-Cys | Cys | Glu | Phe | Cys | Cys | Thr | Pro | Ala | Cys | Thr | Gly | Cys | Lys |
| — | Val | D-Cys | Cys | Glu | Phe | Cys | Cys | Thr | Pro | Ala | Cys | Thr | Gly | Cys | Tyr |
| — | Val | D-Cys | Cys | Glu | Phe | Cys | Cys | Thr | Pro | Ala | Cys | Thr | Gly | D-Cys | — |
| — | Val | D-Cys | Cys | Glu | Phe | Cys | Cys | Thr | Pro | Ala | Cys | Thr | Gly | D-Cys | Lys |
| — | Val | D-Cys | Cys | Glu | Phe | Cys | Cys | Thr | Pro | Ala | Cys | Thr | Gly | D-Cys | Tyr |
| — | Val | D-Cys | Cys | Glu | Phe | D-Cys | Cys | Asn | Pro | Ala | Cys | Thr | Gly | Cys | — |
| — | Val | D-Cys | Cys | Glu | Phe | D-Cys | Cys | Asn | Pro | Ala | Cys | Thr | Gly | Cys | Lys |
| — | Val | D-Cys | Cys | Glu | Phe | D-Cys | Cys | Asn | Pro | Ala | Cys | Thr | Gly | Cys | Tyr |
| — | Val | D-Cys | Cys | Glu | Phe | D-Cys | Cys | Asn | Pro | Ala | Cys | Thr | Gly | D-Cys | — |
| — | Val | D-Cys | Cys | Glu | Phe | D-Cys | Cys | Asn | Pro | Ala | Cys | Thr | Gly | D-Cys | Lys |
| — | Val | D-Cys | Cys | Glu | Phe | D-Cys | Cys | Asn | Pro | Ala | Cys | Thr | Gly | D-Cys | Tyr |
| — | Val | D-Cys | Cys | Glu | Phe | D-Cys | Cys | Thr | Pro | Ala | Cys | Thr | Gly | Cys | — |
| — | Val | D-Cys | Cys | Glu | Phe | D-Cys | Cys | Thr | Pro | Ala | Cys | Thr | Gly | Cys | Lys |
| — | Val | D-Cys | Cys | Glu | Phe | D-Cys | Cys | Thr | Pro | Ala | Cys | Thr | Gly | Cys | Tyr |
| — | Val | D-Cys | Cys | Glu | Phe | D-Cys | Cys | Thr | Pro | Ala | Cys | Thr | Gly | D-Cys | — |
| — | Val | D-Cys | Cys | Glu | Phe | D-Cys | Cys | Thr | Pro | Ala | Cys | Thr | Gly | D-Cys | Lys |
| — | Val | D-Cys | Cys | Glu | Phe | D-Cys | Cys | Thr | Pro | Ala | Cys | Thr | Gly | D-Cys | Tyr |
| — | Val | D-Cys | Cys | Glu | Trp | Cys | Cys | Asn | Pro | Ala | Cys | Thr | Gly | Cys | — |
| — | Val | D-Cys | Cys | Glu | Trp | Cys | Cys | Asn | Pro | Ala | Cys | Thr | Gly | Cys | Lys |
| — | Val | D-Cys | Cys | Glu | Trp | Cys | Cys | Asn | Pro | Ala | Cys | Thr | Gly | Cys | Tyr |
| — | Val | D-Cys | Cys | Glu | Trp | Cys | Cys | Asn | Pro | Ala | Cys | Thr | Gly | D-Cys | — |
| — | Val | D-Cys | Cys | Glu | Trp | Cys | Cys | Asn | Pro | Ala | Cys | Thr | Gly | D-Cys | Lys |
| — | Val | D-Cys | Cys | Glu | Trp | Cys | Cys | Asn | Pro | Ala | Cys | Thr | Gly | D-Cys | Tyr |
| — | Val | D-Cys | Cys | Glu | Trp | Cys | Cys | Thr | Pro | Ala | Cys | Thr | Gly | Cys | — |
| — | Val | D-Cys | Cys | Glu | Trp | Cys | Cys | Thr | Pro | Ala | Cys | Thr | Gly | Cys | Lys |
| — | Val | D-Cys | Cys | Glu | Trp | Cys | Cys | Thr | Pro | Ala | Cys | Thr | Gly | Cys | Tyr |
| — | Val | D-Cys | Cys | Glu | Trp | Cys | Cys | Thr | Pro | Ala | Cys | Thr | Gly | D-Cys | — |
| — | Val | D-Cys | Cys | Glu | Trp | Cys | Cys | Thr | Pro | Ala | Cys | Thr | Gly | D-Cys | Lys |
| — | Val | D-Cys | Cys | Glu | Trp | Cys | Cys | Thr | Pro | Ala | Cys | Thr | Gly | D-Cys | Tyr |
| — | Val | D-Cys | Cys | Glu | Trp | D-Cys | Cys | Asn | Pro | Ala | Cys | Thr | Gly | Cys | — |
| — | Val | D-Cys | Cys | Glu | Trp | D-Cys | Cys | Asn | Pro | Ala | Cys | Thr | Gly | Cys | Lys |
| — | Val | D-Cys | Cys | Glu | Trp | D-Cys | Cys | Asn | Pro | Ala | Cys | Thr | Gly | Cys | Tyr |
| — | Val | D-Cys | Cys | Glu | Trp | D-Cys | Cys | Asn | Pro | Ala | Cys | Thr | Gly | D-Cys | — |
| — | Val | D-Cys | Cys | Glu | Trp | D-Cys | Cys | Asn | Pro | Ala | Cys | Thr | Gly | D-Cys | Lys |
| — | Val | D-Cys | Cys | Glu | Trp | D-Cys | Cys | Asn | Pro | Ala | Cys | Thr | Gly | D-Cys | Tyr |
| — | Val | D-Cys | Cys | Glu | Trp | D-Cys | Cys | Thr | Pro | Ala | Cys | Thr | Gly | Cys | — |
| — | Val | D-Cys | Cys | Glu | Trp | D-Cys | Cys | Thr | Pro | Ala | Cys | Thr | Gly | Cys | Lys |
| — | Val | D-Cys | Cys | Glu | Trp | D-Cys | Cys | Thr | Pro | Ala | Cys | Thr | Gly | Cys | Tyr |
| — | Val | D-Cys | Cys | Glu | Trp | D-Cys | Cys | Thr | Pro | Ala | Cys | Thr | Gly | D-Cys | — |
| — | Val | D-Cys | Cys | Glu | Trp | D-Cys | Cys | Thr | Pro | Ala | Cys | Thr | Gly | D-Cys | Lys |
| — | Val | D-Cys | Cys | Glu | Trp | D-Cys | Cys | Thr | Pro | Ala | Cys | Thr | Gly | D-Cys | Tyr |
| Ala | — | Cys | Cys | Glu | Val | Cys | Cys | Asn | Pro | Ala | Cys | Thr | Gly | Cys | — |
| Ala | — | Cys | Cys | Glu | Val | Cys | Cys | Asn | Pro | Ala | Cys | Thr | Gly | Cys | Lys |
| Ala | — | Cys | Cys | Glu | Val | Cys | Cys | Asn | Pro | Ala | Cys | Thr | Gly | Cys | Tyr |
| Ala | — | Cys | Cys | Glu | Val | Cys | Cys | Asn | Pro | Ala | Cys | Thr | Gly | D-Cys | — |
| Ala | — | Cys | Cys | Glu | Val | Cys | Cys | Asn | Pro | Ala | Cys | Thr | Gly | D-Cys | Lys |
| Ala | — | Cys | Cys | Glu | Val | Cys | Cys | Asn | Pro | Ala | Cys | Thr | Gly | D-Cys | Tyr |
| Ala | — | Cys | Cys | Glu | Val | Cys | Cys | Thr | Pro | Ala | Cys | Thr | Gly | Cys | — |
| Ala | — | Cys | Cys | Glu | Val | Cys | Cys | Thr | Pro | Ala | Cys | Thr | Gly | Cys | Lys |
| Ala | — | Cys | Cys | Glu | Val | Cys | Cys | Thr | Pro | Ala | Cys | Thr | Gly | Cys | Tyr |
| Ala | — | Cys | Cys | Glu | Val | Cys | Cys | Thr | Pro | Ala | Cys | Thr | Gly | D-Cys | — |
| Ala | — | Cys | Cys | Glu | Val | Cys | Cys | Thr | Pro | Ala | Cys | Thr | Gly | D-Cys | Lys |
| Ala | — | Cys | Cys | Glu | Val | Cys | Cys | Thr | Pro | Ala | Cys | Thr | Gly | D-Cys | Tyr |
| Ala | — | Cys | Cys | Glu | Val | D-Cys | Cys | Asn | Pro | Ala | Cys | Thr | Gly | Cys | — |
| Ala | — | Cys | Cys | Glu | Val | D-Cys | Cys | Asn | Pro | Ala | Cys | Thr | Gly | Cys | Lys |
| Ala | — | Cys | Cys | Glu | Val | D-Cys | Cys | Asn | Pro | Ala | Cys | Thr | Gly | Cys | Tyr |

FIG. 3A-29

| | | | | | | | | | | | | | | |
|---|---|---|---|---|---|---|---|---|---|---|---|---|---|---|
| Ala | — | Cys | Cys | Glu | Val | D-Cys | Cys | Asn | Pro | Ala | Cys | Thr | Gly | D-Cys | — |
| Ala | — | Cys | Cys | Glu | Val | D-Cys | Cys | Asn | Pro | Ala | Cys | Thr | Gly | D-Cys | Lys |
| Ala | — | Cys | Cys | Glu | Val | D-Cys | Cys | Asn | Pro | Ala | Cys | Thr | Gly | D-Cys | Tyr |
| Ala | — | Cys | Cys | Glu | Val | D-Cys | Cys | Thr | Pro | Ala | Cys | Thr | Gly | Cys | — |
| Ala | — | Cys | Cys | Glu | Val | D-Cys | Cys | Thr | Pro | Ala | Cys | Thr | Gly | Cys | Lys |
| Ala | — | Cys | Cys | Glu | Val | D-Cys | Cys | Thr | Pro | Ala | Cys | Thr | Gly | Cys | Tyr |
| Ala | — | Cys | Cys | Glu | Val | D-Cys | Cys | Thr | Pro | Ala | Cys | Thr | Gly | D-Cys | — |
| Ala | — | Cys | Cys | Glu | Val | D-Cys | Cys | Thr | Pro | Ala | Cys | Thr | Gly | D-Cys | Lys |
| Ala | — | Cys | Cys | Glu | Val | D-Cys | Cys | Thr | Pro | Ala | Cys | Thr | Gly | D-Cys | Tyr |
| Ala | — | Cys | Cys | Glu | Ile | Cys | Cys | Asn | Pro | Ala | Cys | Thr | Gly | Cys | — |
| Ala | — | Cys | Cys | Glu | Ile | Cys | Cys | Asn | Pro | Ala | Cys | Thr | Gly | Cys | Lys |
| Ala | — | Cys | Cys | Glu | Ile | Cys | Cys | Asn | Pro | Ala | Cys | Thr | Gly | Cys | Tyr |
| Ala | — | Cys | Cys | Glu | Ile | Cys | Cys | Asn | Pro | Ala | Cys | Thr | Gly | D-Cys | — |
| Ala | — | Cys | Cys | Glu | Ile | Cys | Cys | Asn | Pro | Ala | Cys | Thr | Gly | D-Cys | Lys |
| Ala | — | Cys | Cys | Glu | Ile | Cys | Cys | Asn | Pro | Ala | Cys | Thr | Gly | D-Cys | Tyr |
| Ala | — | Cys | Cys | Glu | Ile | Cys | Cys | Thr | Pro | Ala | Cys | Thr | Gly | Cys | — |
| Ala | — | Cys | Cys | Glu | Ile | Cys | Cys | Thr | Pro | Ala | Cys | Thr | Gly | Cys | Lys |
| Ala | — | Cys | Cys | Glu | Ile | Cys | Cys | Thr | Pro | Ala | Cys | Thr | Gly | Cys | Tyr |
| Ala | — | Cys | Cys | Glu | Ile | Cys | Cys | Thr | Pro | Ala | Cys | Thr | Gly | D-Cys | — |
| Ala | — | Cys | Cys | Glu | Ile | Cys | Cys | Thr | Pro | Ala | Cys | Thr | Gly | D-Cys | Lys |
| Ala | — | Cys | Cys | Glu | Ile | Cys | Cys | Thr | Pro | Ala | Cys | Thr | Gly | D-Cys | Tyr |
| Ala | — | Cys | Cys | Glu | Ile | D-Cys | Cys | Asn | Pro | Ala | Cys | Thr | Gly | Cys | — |
| Ala | — | Cys | Cys | Glu | Ile | D-Cys | Cys | Asn | Pro | Ala | Cys | Thr | Gly | Cys | Lys |
| Ala | — | Cys | Cys | Glu | Ile | D-Cys | Cys | Asn | Pro | Ala | Cys | Thr | Gly | Cys | Tyr |
| Ala | — | Cys | Cys | Glu | Ile | D-Cys | Cys | Asn | Pro | Ala | Cys | Thr | Gly | D-Cys | — |
| Ala | — | Cys | Cys | Glu | Ile | D-Cys | Cys | Asn | Pro | Ala | Cys | Thr | Gly | D-Cys | Lys |
| Ala | — | Cys | Cys | Glu | Ile | D-Cys | Cys | Asn | Pro | Ala | Cys | Thr | Gly | D-Cys | Tyr |
| Ala | — | Cys | Cys | Glu | Ile | D-Cys | Cys | Thr | Pro | Ala | Cys | Thr | Gly | Cys | — |
| Ala | — | Cys | Cys | Glu | Ile | D-Cys | Cys | Thr | Pro | Ala | Cys | Thr | Gly | Cys | Lys |
| Ala | — | Cys | Cys | Glu | Ile | D-Cys | Cys | Thr | Pro | Ala | Cys | Thr | Gly | Cys | Tyr |
| Ala | — | Cys | Cys | Glu | Ile | D-Cys | Cys | Thr | Pro | Ala | Cys | Thr | Gly | D-Cys | — |
| Ala | — | Cys | Cys | Glu | Ile | D-Cys | Cys | Thr | Pro | Ala | Cys | Thr | Gly | D-Cys | Lys |
| Ala | — | Cys | Cys | Glu | Ile | D-Cys | Cys | Thr | Pro | Ala | Cys | Thr | Gly | D-Cys | Tyr |
| Ala | — | Cys | Cys | Glu | Leu | Cys | Cys | Asn | Pro | Ala | Cys | Thr | Gly | Cys | — |
| Ala | — | Cys | Cys | Glu | Leu | Cys | Cys | Asn | Pro | Ala | Cys | Thr | Gly | Cys | Lys |
| Ala | — | Cys | Cys | Glu | Leu | Cys | Cys | Asn | Pro | Ala | Cys | Thr | Gly | Cys | Tyr |
| Ala | — | Cys | Cys | Glu | Leu | Cys | Cys | Asn | Pro | Ala | Cys | Thr | Gly | D-Cys | — |
| Ala | — | Cys | Cys | Glu | Leu | Cys | Cys | Asn | Pro | Ala | Cys | Thr | Gly | D-Cys | Lys |
| Ala | — | Cys | Cys | Glu | Leu | Cys | Cys | Asn | Pro | Ala | Cys | Thr | Gly | D-Cys | Tyr |
| Ala | — | Cys | Cys | Glu | Leu | Cys | Cys | Thr | Pro | Ala | Cys | Thr | Gly | Cys | — |
| Ala | — | Cys | Cys | Glu | Leu | Cys | Cys | Thr | Pro | Ala | Cys | Thr | Gly | Cys | Lys |
| Ala | — | Cys | Cys | Glu | Leu | Cys | Cys | Thr | Pro | Ala | Cys | Thr | Gly | Cys | Tyr |
| Ala | — | Cys | Cys | Glu | Leu | Cys | Cys | Thr | Pro | Ala | Cys | Thr | Gly | D-Cys | — |
| Ala | — | Cys | Cys | Glu | Leu | Cys | Cys | Thr | Pro | Ala | Cys | Thr | Gly | D-Cys | Lys |
| Ala | — | Cys | Cys | Glu | Leu | Cys | Cys | Thr | Pro | Ala | Cys | Thr | Gly | D-Cys | Tyr |
| Ala | — | Cys | Cys | Glu | Leu | D-Cys | Cys | Asn | Pro | Ala | Cys | Thr | Gly | Cys | — |
| Ala | — | Cys | Cys | Glu | Leu | D-Cys | Cys | Asn | Pro | Ala | Cys | Thr | Gly | Cys | Lys |
| Ala | — | Cys | Cys | Glu | Leu | D-Cys | Cys | Asn | Pro | Ala | Cys | Thr | Gly | Cys | Tyr |
| Ala | — | Cys | Cys | Glu | Leu | D-Cys | Cys | Asn | Pro | Ala | Cys | Thr | Gly | D-Cys | — |
| Ala | — | Cys | Cys | Glu | Leu | D-Cys | Cys | Asn | Pro | Ala | Cys | Thr | Gly | D-Cys | Lys |
| Ala | — | Cys | Cys | Glu | Leu | D-Cys | Cys | Asn | Pro | Ala | Cys | Thr | Gly | D-Cys | Tyr |
| Ala | — | Cys | Cys | Glu | Leu | D-Cys | Cys | Thr | Pro | Ala | Cys | Thr | Gly | Cys | — |
| Ala | — | Cys | Cys | Glu | Leu | D-Cys | Cys | Thr | Pro | Ala | Cys | Thr | Gly | Cys | Lys |
| Ala | — | Cys | Cys | Glu | Leu | D-Cys | Cys | Thr | Pro | Ala | Cys | Thr | Gly | Cys | Tyr |
| Ala | — | Cys | Cys | Glu | Leu | D-Cys | Cys | Thr | Pro | Ala | Cys | Thr | Gly | D-Cys | — |
| Ala | — | Cys | Cys | Glu | Leu | D-Cys | Cys | Thr | Pro | Ala | Cys | Thr | Gly | D-Cys | Lys |
| Ala | — | Cys | Cys | Glu | Leu | D-Cys | Cys | Thr | Pro | Ala | Cys | Thr | Gly | D-Cys | Tyr |
| Ala | — | Cys | Cys | Glu | Tyr | Cys | Cys | Asn | Pro | Ala | Cys | Thr | Gly | Cys | — |
| Ala | — | Cys | Cys | Glu | Tyr | Cys | Cys | Asn | Pro | Ala | Cys | Thr | Gly | Cys | Lys |
| Ala | — | Cys | Cys | Glu | Tyr | Cys | Cys | Asn | Pro | Ala | Cys | Thr | Gly | Cys | Tyr |

FIG. 3A-30

| | | | | | | | | | | | | | |
|---|---|---|---|---|---|---|---|---|---|---|---|---|---|
| Ala | — | Cys | Cys | Glu | Tyr | Cys | Cys | Asn | Pro | Ala | Cys | Thr | Gly | D-Cys | — |
| Ala | — | Cys | Cys | Glu | Tyr | Cys | Cys | Asn | Pro | Ala | Cys | Thr | Gly | D-Cys | Lys |
| Ala | — | Cys | Cys | Glu | Tyr | Cys | Cys | Asn | Pro | Ala | Cys | Thr | Gly | D-Cys | Tyr |
| Ala | — | Cys | Cys | Glu | Tyr | Cys | Cys | Thr | Pro | Ala | Cys | Thr | Gly | Cys | — |
| Ala | — | Cys | Cys | Glu | Tyr | Cys | Cys | Thr | Pro | Ala | Cys | Thr | Gly | Cys | Lys |
| Ala | — | Cys | Cys | Glu | Tyr | Cys | Cys | Thr | Pro | Ala | Cys | Thr | Gly | Cys | Tyr |
| Ala | — | Cys | Cys | Glu | Tyr | Cys | Cys | Thr | Pro | Ala | Cys | Thr | Gly | D-Cys | — |
| Ala | — | Cys | Cys | Glu | Tyr | Cys | Cys | Thr | Pro | Ala | Cys | Thr | Gly | D-Cys | Lys |
| Ala | — | Cys | Cys | Glu | Tyr | Cys | Cys | Thr | Pro | Ala | Cys | Thr | Gly | D-Cys | Tyr |
| Ala | — | Cys | Cys | Glu | Tyr | D-Cys | Cys | Asn | Pro | Ala | Cys | Thr | Gly | Cys | — |
| Ala | — | Cys | Cys | Glu | Tyr | D-Cys | Cys | Asn | Pro | Ala | Cys | Thr | Gly | Cys | Lys |
| Ala | — | Cys | Cys | Glu | Tyr | D-Cys | Cys | Asn | Pro | Ala | Cys | Thr | Gly | Cys | Tyr |
| Ala | — | Cys | Cys | Glu | Tyr | D-Cys | Cys | Asn | Pro | Ala | Cys | Thr | Gly | D-Cys | — |
| Ala | — | Cys | Cys | Glu | Tyr | D-Cys | Cys | Asn | Pro | Ala | Cys | Thr | Gly | D-Cys | Lys |
| Ala | — | Cys | Cys | Glu | Tyr | D-Cys | Cys | Asn | Pro | Ala | Cys | Thr | Gly | D-Cys | Tyr |
| Ala | — | Cys | Cys | Glu | Tyr | D-Cys | Cys | Thr | Pro | Ala | Cys | Thr | Gly | Cys | — |
| Ala | — | Cys | Cys | Glu | Tyr | D-Cys | Cys | Thr | Pro | Ala | Cys | Thr | Gly | Cys | Lys |
| Ala | — | Cys | Cys | Glu | Tyr | D-Cys | Cys | Thr | Pro | Ala | Cys | Thr | Gly | Cys | Tyr |
| Ala | — | Cys | Cys | Glu | Tyr | D-Cys | Cys | Thr | Pro | Ala | Cys | Thr | Gly | D-Cys | — |
| Ala | — | Cys | Cys | Glu | Tyr | D-Cys | Cys | Thr | Pro | Ala | Cys | Thr | Gly | D-Cys | Lys |
| Ala | — | Cys | Cys | Glu | Tyr | D-Cys | Cys | Thr | Pro | Ala | Cys | Thr | Gly | D-Cys | Tyr |
| Ala | — | Cys | Cys | Glu | Phe | Cys | Cys | Asn | Pro | Ala | Cys | Thr | Gly | Cys | — |
| Ala | — | Cys | Cys | Glu | Phe | Cys | Cys | Asn | Pro | Ala | Cys | Thr | Gly | Cys | Lys |
| Ala | — | Cys | Cys | Glu | Phe | Cys | Cys | Asn | Pro | Ala | Cys | Thr | Gly | Cys | Tyr |
| Ala | — | Cys | Cys | Glu | Phe | Cys | Cys | Asn | Pro | Ala | Cys | Thr | Gly | D-Cys | — |
| Ala | — | Cys | Cys | Glu | Phe | Cys | Cys | Asn | Pro | Ala | Cys | Thr | Gly | D-Cys | Lys |
| Ala | — | Cys | Cys | Glu | Phe | Cys | Cys | Asn | Pro | Ala | Cys | Thr | Gly | D-Cys | Tyr |
| Ala | — | Cys | Cys | Glu | Phe | Cys | Cys | Thr | Pro | Ala | Cys | Thr | Gly | Cys | — |
| Ala | — | Cys | Cys | Glu | Phe | Cys | Cys | Thr | Pro | Ala | Cys | Thr | Gly | Cys | Lys |
| Ala | — | Cys | Cys | Glu | Phe | Cys | Cys | Thr | Pro | Ala | Cys | Thr | Gly | Cys | Tyr |
| Ala | — | Cys | Cys | Glu | Phe | Cys | Cys | Thr | Pro | Ala | Cys | Thr | Gly | D-Cys | — |
| Ala | — | Cys | Cys | Glu | Phe | Cys | Cys | Thr | Pro | Ala | Cys | Thr | Gly | D-Cys | Lys |
| Ala | — | Cys | Cys | Glu | Phe | Cys | Cys | Thr | Pro | Ala | Cys | Thr | Gly | D-Cys | Tyr |
| Ala | — | Cys | Cys | Glu | Phe | D-Cys | Cys | Asn | Pro | Ala | Cys | Thr | Gly | Cys | — |
| Ala | — | Cys | Cys | Glu | Phe | D-Cys | Cys | Asn | Pro | Ala | Cys | Thr | Gly | Cys | Lys |
| Ala | — | Cys | Cys | Glu | Phe | D-Cys | Cys | Asn | Pro | Ala | Cys | Thr | Gly | Cys | Tyr |
| Ala | — | Cys | Cys | Glu | Phe | D-Cys | Cys | Asn | Pro | Ala | Cys | Thr | Gly | D-Cys | — |
| Ala | — | Cys | Cys | Glu | Phe | D-Cys | Cys | Asn | Pro | Ala | Cys | Thr | Gly | D-Cys | Lys |
| Ala | — | Cys | Cys | Glu | Phe | D-Cys | Cys | Asn | Pro | Ala | Cys | Thr | Gly | D-Cys | Tyr |
| Ala | — | Cys | Cys | Glu | Phe | D-Cys | Cys | Thr | Pro | Ala | Cys | Thr | Gly | Cys | — |
| Ala | — | Cys | Cys | Glu | Phe | D-Cys | Cys | Thr | Pro | Ala | Cys | Thr | Gly | Cys | Lys |
| Ala | — | Cys | Cys | Glu | Phe | D-Cys | Cys | Thr | Pro | Ala | Cys | Thr | Gly | Cys | Tyr |
| Ala | — | Cys | Cys | Glu | Phe | D-Cys | Cys | Thr | Pro | Ala | Cys | Thr | Gly | D-Cys | — |
| Ala | — | Cys | Cys | Glu | Phe | D-Cys | Cys | Thr | Pro | Ala | Cys | Thr | Gly | D-Cys | Lys |
| Ala | — | Cys | Cys | Glu | Phe | D-Cys | Cys | Thr | Pro | Ala | Cys | Thr | Gly | D-Cys | Tyr |
| Ala | — | Cys | Cys | Glu | Trp | Cys | Cys | Asn | Pro | Ala | Cys | Thr | Gly | Cys | — |
| Ala | — | Cys | Cys | Glu | Trp | Cys | Cys | Asn | Pro | Ala | Cys | Thr | Gly | Cys | Lys |
| Ala | — | Cys | Cys | Glu | Trp | Cys | Cys | Asn | Pro | Ala | Cys | Thr | Gly | Cys | Tyr |
| Ala | — | Cys | Cys | Glu | Trp | Cys | Cys | Asn | Pro | Ala | Cys | Thr | Gly | D-Cys | — |
| Ala | — | Cys | Cys | Glu | Trp | Cys | Cys | Asn | Pro | Ala | Cys | Thr | Gly | D-Cys | Lys |
| Ala | — | Cys | Cys | Glu | Trp | Cys | Cys | Asn | Pro | Ala | Cys | Thr | Gly | D-Cys | Tyr |
| Ala | — | Cys | Cys | Glu | Trp | Cys | Cys | Thr | Pro | Ala | Cys | Thr | Gly | Cys | — |
| Ala | — | Cys | Cys | Glu | Trp | Cys | Cys | Thr | Pro | Ala | Cys | Thr | Gly | Cys | Lys |
| Ala | — | Cys | Cys | Glu | Trp | Cys | Cys | Thr | Pro | Ala | Cys | Thr | Gly | Cys | Tyr |
| Ala | — | Cys | Cys | Glu | Trp | Cys | Cys | Thr | Pro | Ala | Cys | Thr | Gly | D-Cys | — |
| Ala | — | Cys | Cys | Glu | Trp | Cys | Cys | Thr | Pro | Ala | Cys | Thr | Gly | D-Cys | Lys |
| Ala | — | Cys | Cys | Glu | Trp | Cys | Cys | Thr | Pro | Ala | Cys | Thr | Gly | D-Cys | Tyr |
| Ala | — | Cys | Cys | Glu | Trp | D-Cys | Cys | Asn | Pro | Ala | Cys | Thr | Gly | Cys | — |
| Ala | — | Cys | Cys | Glu | Trp | D-Cys | Cys | Asn | Pro | Ala | Cys | Thr | Gly | Cys | Lys |
| Ala | — | Cys | Cys | Glu | Trp | D-Cys | Cys | Asn | Pro | Ala | Cys | Thr | Gly | Cys | Tyr |

FIG. 3A-31

| | | | | | | | | | | | | | | |
|---|---|---|---|---|---|---|---|---|---|---|---|---|---|---|
| Ala | — | Cys | Cys | Glu | Trp | D-Cys | Cys | Asn | Pro | Ala | Cys | Thr | Gly | D-Cys | — |
| Ala | — | Cys | Cys | Glu | Trp | D-Cys | Cys | Asn | Pro | Ala | Cys | Thr | Gly | D-Cys | Lys |
| Ala | — | Cys | Cys | Glu | Trp | D-Cys | Cys | Asn | Pro | Ala | Cys | Thr | Gly | D-Cys | Tyr |
| Ala | — | Cys | Cys | Glu | Trp | D-Cys | Cys | Thr | Pro | Ala | Cys | Thr | Gly | Cys | — |
| Ala | — | Cys | Cys | Glu | Trp | D-Cys | Cys | Thr | Pro | Ala | Cys | Thr | Gly | Cys | Lys |
| Ala | — | Cys | Cys | Glu | Trp | D-Cys | Cys | Thr | Pro | Ala | Cys | Thr | Gly | Cys | Tyr |
| Ala | — | Cys | Cys | Glu | Trp | D-Cys | Cys | Thr | Pro | Ala | Cys | Thr | Gly | D-Cys | — |
| Ala | — | Cys | Cys | Glu | Trp | D-Cys | Cys | Thr | Pro | Ala | Cys | Thr | Gly | D-Cys | Lys |
| Ala | — | Cys | Cys | Glu | Trp | D-Cys | Cys | Thr | Pro | Ala | Cys | Thr | Gly | D-Cys | Tyr |
| Ala | — | D-Cys | Cys | Glu | Val | Cys | Cys | Asn | Pro | Ala | Cys | Thr | Gly | Cys | — |
| Ala | — | D-Cys | Cys | Glu | Val | Cys | Cys | Asn | Pro | Ala | Cys | Thr | Gly | Cys | Lys |
| Ala | — | D-Cys | Cys | Glu | Val | Cys | Cys | Asn | Pro | Ala | Cys | Thr | Gly | Cys | Tyr |
| Ala | — | D-Cys | Cys | Glu | Val | Cys | Cys | Asn | Pro | Ala | Cys | Thr | Gly | D-Cys | — |
| Ala | — | D-Cys | Cys | Glu | Val | Cys | Cys | Asn | Pro | Ala | Cys | Thr | Gly | D-Cys | Lys |
| Ala | — | D-Cys | Cys | Glu | Val | Cys | Cys | Asn | Pro | Ala | Cys | Thr | Gly | D-Cys | Tyr |
| Ala | — | D-Cys | Cys | Glu | Val | Cys | Cys | Thr | Pro | Ala | Cys | Thr | Gly | Cys | — |
| Ala | — | D-Cys | Cys | Glu | Val | Cys | Cys | Thr | Pro | Ala | Cys | Thr | Gly | Cys | Lys |
| Ala | — | D-Cys | Cys | Glu | Val | Cys | Cys | Thr | Pro | Ala | Cys | Thr | Gly | Cys | Tyr |
| Ala | — | D-Cys | Cys | Glu | Val | Cys | Cys | Thr | Pro | Ala | Cys | Thr | Gly | D-Cys | — |
| Ala | — | D-Cys | Cys | Glu | Val | Cys | Cys | Thr | Pro | Ala | Cys | Thr | Gly | D-Cys | Lys |
| Ala | — | D-Cys | Cys | Glu | Val | Cys | Cys | Thr | Pro | Ala | Cys | Thr | Gly | D-Cys | Tyr |
| Ala | — | D-Cys | Cys | Glu | Val | D-Cys | Cys | Asn | Pro | Ala | Cys | Thr | Gly | Cys | — |
| Ala | — | D-Cys | Cys | Glu | Val | D-Cys | Cys | Asn | Pro | Ala | Cys | Thr | Gly | Cys | Lys |
| Ala | — | D-Cys | Cys | Glu | Val | D-Cys | Cys | Asn | Pro | Ala | Cys | Thr | Gly | Cys | Tyr |
| Ala | — | D-Cys | Cys | Glu | Val | D-Cys | Cys | Asn | Pro | Ala | Cys | Thr | Gly | D-Cys | — |
| Ala | — | D-Cys | Cys | Glu | Val | D-Cys | Cys | Asn | Pro | Ala | Cys | Thr | Gly | D-Cys | Lys |
| Ala | — | D-Cys | Cys | Glu | Val | D-Cys | Cys | Asn | Pro | Ala | Cys | Thr | Gly | D-Cys | Tyr |
| Ala | — | D-Cys | Cys | Glu | Val | D-Cys | Cys | Thr | Pro | Ala | Cys | Thr | Gly | Cys | — |
| Ala | — | D-Cys | Cys | Glu | Val | D-Cys | Cys | Thr | Pro | Ala | Cys | Thr | Gly | Cys | Lys |
| Ala | — | D-Cys | Cys | Glu | Val | D-Cys | Cys | Thr | Pro | Ala | Cys | Thr | Gly | Cys | Tyr |
| Ala | — | D-Cys | Cys | Glu | Val | D-Cys | Cys | Thr | Pro | Ala | Cys | Thr | Gly | D-Cys | — |
| Ala | — | D-Cys | Cys | Glu | Val | D-Cys | Cys | Thr | Pro | Ala | Cys | Thr | Gly | D-Cys | Lys |
| Ala | — | D-Cys | Cys | Glu | Val | D-Cys | Cys | Thr | Pro | Ala | Cys | Thr | Gly | D-Cys | Tyr |
| Ala | — | D-Cys | Cys | Glu | Ile | Cys | Cys | Asn | Pro | Ala | Cys | Thr | Gly | Cys | — |
| Ala | — | D-Cys | Cys | Glu | Ile | Cys | Cys | Asn | Pro | Ala | Cys | Thr | Gly | Cys | Lys |
| Ala | — | D-Cys | Cys | Glu | Ile | Cys | Cys | Asn | Pro | Ala | Cys | Thr | Gly | Cys | Tyr |
| Ala | — | D-Cys | Cys | Glu | Ile | Cys | Cys | Asn | Pro | Ala | Cys | Thr | Gly | D-Cys | — |
| Ala | — | D-Cys | Cys | Glu | Ile | Cys | Cys | Asn | Pro | Ala | Cys | Thr | Gly | D-Cys | Lys |
| Ala | — | D-Cys | Cys | Glu | Ile | Cys | Cys | Asn | Pro | Ala | Cys | Thr | Gly | D-Cys | Tyr |
| Ala | — | D-Cys | Cys | Glu | Ile | Cys | Cys | Thr | Pro | Ala | Cys | Thr | Gly | Cys | — |
| Ala | — | D-Cys | Cys | Glu | Ile | Cys | Cys | Thr | Pro | Ala | Cys | Thr | Gly | Cys | Lys |
| Ala | — | D-Cys | Cys | Glu | Ile | Cys | Cys | Thr | Pro | Ala | Cys | Thr | Gly | Cys | Tyr |
| Ala | — | D-Cys | Cys | Glu | Ile | Cys | Cys | Thr | Pro | Ala | Cys | Thr | Gly | D-Cys | — |
| Ala | — | D-Cys | Cys | Glu | Ile | Cys | Cys | Thr | Pro | Ala | Cys | Thr | Gly | D-Cys | Lys |
| Ala | — | D-Cys | Cys | Glu | Ile | Cys | Cys | Thr | Pro | Ala | Cys | Thr | Gly | D-Cys | Tyr |
| Ala | — | D-Cys | Cys | Glu | Ile | D-Cys | Cys | Asn | Pro | Ala | Cys | Thr | Gly | Cys | — |
| Ala | — | D-Cys | Cys | Glu | Ile | D-Cys | Cys | Asn | Pro | Ala | Cys | Thr | Gly | Cys | Lys |
| Ala | — | D-Cys | Cys | Glu | Ile | D-Cys | Cys | Asn | Pro | Ala | Cys | Thr | Gly | Cys | Tyr |
| Ala | — | D-Cys | Cys | Glu | Ile | D-Cys | Cys | Asn | Pro | Ala | Cys | Thr | Gly | D-Cys | — |
| Ala | — | D-Cys | Cys | Glu | Ile | D-Cys | Cys | Asn | Pro | Ala | Cys | Thr | Gly | D-Cys | Lys |
| Ala | — | D-Cys | Cys | Glu | Ile | D-Cys | Cys | Asn | Pro | Ala | Cys | Thr | Gly | D-Cys | Tyr |
| Ala | — | D-Cys | Cys | Glu | Ile | D-Cys | Cys | Thr | Pro | Ala | Cys | Thr | Gly | Cys | — |
| Ala | — | D-Cys | Cys | Glu | Ile | D-Cys | Cys | Thr | Pro | Ala | Cys | Thr | Gly | Cys | Lys |
| Ala | — | D-Cys | Cys | Glu | Ile | D-Cys | Cys | Thr | Pro | Ala | Cys | Thr | Gly | Cys | Tyr |
| Ala | — | D-Cys | Cys | Glu | Ile | D-Cys | Cys | Thr | Pro | Ala | Cys | Thr | Gly | D-Cys | — |
| Ala | — | D-Cys | Cys | Glu | Ile | D-Cys | Cys | Thr | Pro | Ala | Cys | Thr | Gly | D-Cys | Lys |
| Ala | — | D-Cys | Cys | Glu | Ile | D-Cys | Cys | Thr | Pro | Ala | Cys | Thr | Gly | D-Cys | Tyr |
| Ala | — | D-Cys | Cys | Glu | Leu | Cys | Cys | Asn | Pro | Ala | Cys | Thr | Gly | Cys | — |
| Ala | — | D-Cys | Cys | Glu | Leu | Cys | Cys | Asn | Pro | Ala | Cys | Thr | Gly | Cys | Lys |
| Ala | — | D-Cys | Cys | Glu | Leu | Cys | Cys | Asn | Pro | Ala | Cys | Thr | Gly | Cys | Tyr |

FIG. 3A-32

| Ala | — | D-Cys | Cys | Glu | Leu | Cys | Cys | Asn | Pro | Ala | Cys | Thr | Gly | D-Cys | — |
|---|---|---|---|---|---|---|---|---|---|---|---|---|---|---|---|
| Ala | — | D-Cys | Cys | Glu | Leu | Cys | Cys | Asn | Pro | Ala | Cys | Thr | Gly | D-Cys | Lys |
| Ala | — | D-Cys | Cys | Glu | Leu | Cys | Cys | Asn | Pro | Ala | Cys | Thr | Gly | D-Cys | Tyr |
| Ala | — | D-Cys | Cys | Glu | Leu | Cys | Cys | Thr | Pro | Ala | Cys | Thr | Gly | Cys | — |
| Ala | — | D-Cys | Cys | Glu | Leu | Cys | Cys | Thr | Pro | Ala | Cys | Thr | Gly | Cys | Lys |
| Ala | — | D-Cys | Cys | Glu | Leu | Cys | Cys | Thr | Pro | Ala | Cys | Thr | Gly | Cys | Tyr |
| Ala | — | D-Cys | Cys | Glu | Leu | Cys | Cys | Thr | Pro | Ala | Cys | Thr | Gly | D-Cys | — |
| Ala | — | D-Cys | Cys | Glu | Leu | Cys | Cys | Thr | Pro | Ala | Cys | Thr | Gly | D-Cys | Lys |
| Ala | — | D-Cys | Cys | Glu | Leu | Cys | Cys | Thr | Pro | Ala | Cys | Thr | Gly | D-Cys | Tyr |
| Ala | — | D-Cys | Cys | Glu | Leu | D-Cys | Cys | Asn | Pro | Ala | Cys | Thr | Gly | Cys | — |
| Ala | — | D-Cys | Cys | Glu | Leu | D-Cys | Cys | Asn | Pro | Ala | Cys | Thr | Gly | Cys | Lys |
| Ala | — | D-Cys | Cys | Glu | Leu | D-Cys | Cys | Asn | Pro | Ala | Cys | Thr | Gly | Cys | Tyr |
| Ala | — | D-Cys | Cys | Glu | Leu | D-Cys | Cys | Asn | Pro | Ala | Cys | Thr | Gly | D-Cys | — |
| Ala | — | D-Cys | Cys | Glu | Leu | D-Cys | Cys | Asn | Pro | Ala | Cys | Thr | Gly | D-Cys | Lys |
| Ala | — | D-Cys | Cys | Glu | Leu | D-Cys | Cys | Asn | Pro | Ala | Cys | Thr | Gly | D-Cys | Tyr |
| Ala | — | D-Cys | Cys | Glu | Leu | D-Cys | Cys | Thr | Pro | Ala | Cys | Thr | Gly | Cys | — |
| Ala | — | D-Cys | Cys | Glu | Leu | D-Cys | Cys | Thr | Pro | Ala | Cys | Thr | Gly | Cys | Lys |
| Ala | — | D-Cys | Cys | Glu | Leu | D-Cys | Cys | Thr | Pro | Ala | Cys | Thr | Gly | Cys | Tyr |
| Ala | — | D-Cys | Cys | Glu | Leu | D-Cys | Cys | Thr | Pro | Ala | Cys | Thr | Gly | D-Cys | — |
| Ala | — | D-Cys | Cys | Glu | Leu | D-Cys | Cys | Thr | Pro | Ala | Cys | Thr | Gly | D-Cys | Lys |
| Ala | — | D-Cys | Cys | Glu | Leu | D-Cys | Cys | Thr | Pro | Ala | Cys | Thr | Gly | D-Cys | Tyr |
| Ala | — | D-Cys | Cys | Glu | Tyr | Cys | Cys | Asn | Pro | Ala | Cys | Thr | Gly | Cys | — |
| Ala | — | D-Cys | Cys | Glu | Tyr | Cys | Cys | Asn | Pro | Ala | Cys | Thr | Gly | Cys | Lys |
| Ala | — | D-Cys | Cys | Glu | Tyr | Cys | Cys | Asn | Pro | Ala | Cys | Thr | Gly | Cys | Tyr |
| Ala | — | D-Cys | Cys | Glu | Tyr | Cys | Cys | Asn | Pro | Ala | Cys | Thr | Gly | D-Cys | — |
| Ala | — | D-Cys | Cys | Glu | Tyr | Cys | Cys | Asn | Pro | Ala | Cys | Thr | Gly | D-Cys | Lys |
| Ala | — | D-Cys | Cys | Glu | Tyr | Cys | Cys | Asn | Pro | Ala | Cys | Thr | Gly | D-Cys | Tyr |
| Ala | — | D-Cys | Cys | Glu | Tyr | Cys | Cys | Thr | Pro | Ala | Cys | Thr | Gly | Cys | — |
| Ala | — | D-Cys | Cys | Glu | Tyr | Cys | Cys | Thr | Pro | Ala | Cys | Thr | Gly | Cys | Lys |
| Ala | — | D-Cys | Cys | Glu | Tyr | Cys | Cys | Thr | Pro | Ala | Cys | Thr | Gly | Cys | Tyr |
| Ala | — | D-Cys | Cys | Glu | Tyr | Cys | Cys | Thr | Pro | Ala | Cys | Thr | Gly | D-Cys | — |
| Ala | — | D-Cys | Cys | Glu | Tyr | Cys | Cys | Thr | Pro | Ala | Cys | Thr | Gly | D-Cys | Lys |
| Ala | — | D-Cys | Cys | Glu | Tyr | Cys | Cys | Thr | Pro | Ala | Cys | Thr | Gly | D-Cys | Tyr |
| Ala | — | D-Cys | Cys | Glu | Tyr | D-Cys | Cys | Asn | Pro | Ala | Cys | Thr | Gly | Cys | — |
| Ala | — | D-Cys | Cys | Glu | Tyr | D-Cys | Cys | Asn | Pro | Ala | Cys | Thr | Gly | Cys | Lys |
| Ala | — | D-Cys | Cys | Glu | Tyr | D-Cys | Cys | Asn | Pro | Ala | Cys | Thr | Gly | Cys | Tyr |
| Ala | — | D-Cys | Cys | Glu | Tyr | D-Cys | Cys | Asn | Pro | Ala | Cys | Thr | Gly | D-Cys | — |
| Ala | — | D-Cys | Cys | Glu | Tyr | D-Cys | Cys | Asn | Pro | Ala | Cys | Thr | Gly | D-Cys | Lys |
| Ala | — | D-Cys | Cys | Glu | Tyr | D-Cys | Cys | Asn | Pro | Ala | Cys | Thr | Gly | D-Cys | Tyr |
| Ala | — | D-Cys | Cys | Glu | Tyr | D-Cys | Cys | Thr | Pro | Ala | Cys | Thr | Gly | Cys | — |
| Ala | — | D-Cys | Cys | Glu | Tyr | D-Cys | Cys | Thr | Pro | Ala | Cys | Thr | Gly | Cys | Lys |
| Ala | — | D-Cys | Cys | Glu | Tyr | D-Cys | Cys | Thr | Pro | Ala | Cys | Thr | Gly | Cys | Tyr |
| Ala | — | D-Cys | Cys | Glu | Tyr | D-Cys | Cys | Thr | Pro | Ala | Cys | Thr | Gly | D-Cys | — |
| Ala | — | D-Cys | Cys | Glu | Tyr | D-Cys | Cys | Thr | Pro | Ala | Cys | Thr | Gly | D-Cys | Lys |
| Ala | — | D-Cys | Cys | Glu | Tyr | D-Cys | Cys | Thr | Pro | Ala | Cys | Thr | Gly | D-Cys | Tyr |
| Ala | — | D-Cys | Cys | Glu | Phe | Cys | Cys | Asn | Pro | Ala | Cys | Thr | Gly | Cys | — |
| Ala | — | D-Cys | Cys | Glu | Phe | Cys | Cys | Asn | Pro | Ala | Cys | Thr | Gly | Cys | Lys |
| Ala | — | D-Cys | Cys | Glu | Phe | Cys | Cys | Asn | Pro | Ala | Cys | Thr | Gly | Cys | Tyr |
| Ala | — | D-Cys | Cys | Glu | Phe | Cys | Cys | Asn | Pro | Ala | Cys | Thr | Gly | D-Cys | — |
| Ala | — | D-Cys | Cys | Glu | Phe | Cys | Cys | Asn | Pro | Ala | Cys | Thr | Gly | D-Cys | Lys |
| Ala | — | D-Cys | Cys | Glu | Phe | Cys | Cys | Asn | Pro | Ala | Cys | Thr | Gly | D-Cys | Tyr |
| Ala | — | D-Cys | Cys | Glu | Phe | Cys | Cys | Thr | Pro | Ala | Cys | Thr | Gly | Cys | — |
| Ala | — | D-Cys | Cys | Glu | Phe | Cys | Cys | Thr | Pro | Ala | Cys | Thr | Gly | Cys | Lys |
| Ala | — | D-Cys | Cys | Glu | Phe | Cys | Cys | Thr | Pro | Ala | Cys | Thr | Gly | Cys | Tyr |
| Ala | — | D-Cys | Cys | Glu | Phe | Cys | Cys | Thr | Pro | Ala | Cys | Thr | Gly | D-Cys | — |
| Ala | — | D-Cys | Cys | Glu | Phe | Cys | Cys | Thr | Pro | Ala | Cys | Thr | Gly | D-Cys | Lys |
| Ala | — | D-Cys | Cys | Glu | Phe | Cys | Cys | Thr | Pro | Ala | Cys | Thr | Gly | D-Cys | Tyr |
| Ala | — | D-Cys | Cys | Glu | Phe | D-Cys | Cys | Asn | Pro | Ala | Cys | Thr | Gly | Cys | — |
| Ala | — | D-Cys | Cys | Glu | Phe | D-Cys | Cys | Asn | Pro | Ala | Cys | Thr | Gly | Cys | Lys |
| Ala | — | D-Cys | Cys | Glu | Phe | D-Cys | Cys | Asn | Pro | Ala | Cys | Thr | Gly | Cys | Tyr |

FIG. 3A-33

| | | | | | | | | | | | | | |
|---|---|---|---|---|---|---|---|---|---|---|---|---|---|
| Ala | — | D-Cys | Cys | Glu | Phe | D-Cys | Cys | Asn | Pro | Ala | Cys | Thr | Gly | D-Cys | — |
| Ala | — | D-Cys | Cys | Glu | Phe | D-Cys | Cys | Asn | Pro | Ala | Cys | Thr | Gly | D-Cys | Lys |
| Ala | — | D-Cys | Cys | Glu | Phe | D-Cys | Cys | Asn | Pro | Ala | Cys | Thr | Gly | D-Cys | Tyr |
| Ala | — | D-Cys | Cys | Glu | Phe | D-Cys | Cys | Thr | Pro | Ala | Cys | Thr | Gly | Cys | — |
| Ala | — | D-Cys | Cys | Glu | Phe | D-Cys | Cys | Thr | Pro | Ala | Cys | Thr | Gly | Cys | Lys |
| Ala | — | D-Cys | Cys | Glu | Phe | D-Cys | Cys | Thr | Pro | Ala | Cys | Thr | Gly | Cys | Tyr |
| Ala | — | D-Cys | Cys | Glu | Phe | D-Cys | Cys | Thr | Pro | Ala | Cys | Thr | Gly | D-Cys | — |
| Ala | — | D-Cys | Cys | Glu | Phe | D-Cys | Cys | Thr | Pro | Ala | Cys | Thr | Gly | D-Cys | Lys |
| Ala | — | D-Cys | Cys | Glu | Phe | D-Cys | Cys | Thr | Pro | Ala | Cys | Thr | Gly | D-Cys | Tyr |
| Ala | — | D-Cys | Cys | Glu | Trp | Cys | Cys | Asn | Pro | Ala | Cys | Thr | Gly | Cys | — |
| Ala | — | D-Cys | Cys | Glu | Trp | Cys | Cys | Asn | Pro | Ala | Cys | Thr | Gly | Cys | Lys |
| Ala | — | D-Cys | Cys | Glu | Trp | Cys | Cys | Asn | Pro | Ala | Cys | Thr | Gly | Cys | Tyr |
| Ala | — | D-Cys | Cys | Glu | Trp | Cys | Cys | Asn | Pro | Ala | Cys | Thr | Gly | D-Cys | — |
| Ala | — | D-Cys | Cys | Glu | Trp | Cys | Cys | Asn | Pro | Ala | Cys | Thr | Gly | D-Cys | Lys |
| Ala | — | D-Cys | Cys | Glu | Trp | Cys | Cys | Asn | Pro | Ala | Cys | Thr | Gly | D-Cys | Tyr |
| Ala | — | D-Cys | Cys | Glu | Trp | Cys | Cys | Thr | Pro | Ala | Cys | Thr | Gly | Cys | — |
| Ala | — | D-Cys | Cys | Glu | Trp | Cys | Cys | Thr | Pro | Ala | Cys | Thr | Gly | Cys | Lys |
| Ala | — | D-Cys | Cys | Glu | Trp | Cys | Cys | Thr | Pro | Ala | Cys | Thr | Gly | Cys | Tyr |
| Ala | — | D-Cys | Cys | Glu | Trp | Cys | Cys | Thr | Pro | Ala | Cys | Thr | Gly | D-Cys | — |
| Ala | — | D-Cys | Cys | Glu | Trp | Cys | Cys | Thr | Pro | Ala | Cys | Thr | Gly | D-Cys | Lys |
| Ala | — | D-Cys | Cys | Glu | Trp | Cys | Cys | Thr | Pro | Ala | Cys | Thr | Gly | D-Cys | Tyr |
| Ala | — | D-Cys | Cys | Glu | Trp | D-Cys | Cys | Asn | Pro | Ala | Cys | Thr | Gly | Cys | — |
| Ala | — | D-Cys | Cys | Glu | Trp | D-Cys | Cys | Asn | Pro | Ala | Cys | Thr | Gly | Cys | Lys |
| Ala | — | D-Cys | Cys | Glu | Trp | D-Cys | Cys | Asn | Pro | Ala | Cys | Thr | Gly | Cys | Tyr |
| Ala | — | D-Cys | Cys | Glu | Trp | D-Cys | Cys | Asn | Pro | Ala | Cys | Thr | Gly | D-Cys | — |
| Ala | — | D-Cys | Cys | Glu | Trp | D-Cys | Cys | Asn | Pro | Ala | Cys | Thr | Gly | D-Cys | Lys |
| Ala | — | D-Cys | Cys | Glu | Trp | D-Cys | Cys | Asn | Pro | Ala | Cys | Thr | Gly | D-Cys | Tyr |
| Ala | — | D-Cys | Cys | Glu | Trp | D-Cys | Cys | Thr | Pro | Ala | Cys | Thr | Gly | Cys | — |
| Ala | — | D-Cys | Cys | Glu | Trp | D-Cys | Cys | Thr | Pro | Ala | Cys | Thr | Gly | Cys | Lys |
| Ala | — | D-Cys | Cys | Glu | Trp | D-Cys | Cys | Thr | Pro | Ala | Cys | Thr | Gly | Cys | Tyr |
| Ala | — | D-Cys | Cys | Glu | Trp | D-Cys | Cys | Thr | Pro | Ala | Cys | Thr | Gly | D-Cys | — |
| Ala | — | D-Cys | Cys | Glu | Trp | D-Cys | Cys | Thr | Pro | Ala | Cys | Thr | Gly | D-Cys | Lys |
| Ala | — | D-Cys | Cys | Glu | Trp | D-Cys | Cys | Thr | Pro | Ala | Cys | Thr | Gly | D-Cys | Tyr |
| Ala | Ala | Cys | Cys | Glu | Val | Cys | Cys | Asn | Pro | Ala | Cys | Thr | Gly | Cys | — |
| Ala | Ala | Cys | Cys | Glu | Val | Cys | Cys | Asn | Pro | Ala | Cys | Thr | Gly | Cys | Lys |
| Ala | Ala | Cys | Cys | Glu | Val | Cys | Cys | Asn | Pro | Ala | Cys | Thr | Gly | Cys | Tyr |
| Ala | Ala | Cys | Cys | Glu | Val | Cys | Cys | Asn | Pro | Ala | Cys | Thr | Gly | D-Cys | — |
| Ala | Ala | Cys | Cys | Glu | Val | Cys | Cys | Asn | Pro | Ala | Cys | Thr | Gly | D-Cys | Lys |
| Ala | Ala | Cys | Cys | Glu | Val | Cys | Cys | Asn | Pro | Ala | Cys | Thr | Gly | D-Cys | Tyr |
| Ala | Ala | Cys | Cys | Glu | Val | Cys | Cys | Thr | Pro | Ala | Cys | Thr | Gly | Cys | — |
| Ala | Ala | Cys | Cys | Glu | Val | Cys | Cys | Thr | Pro | Ala | Cys | Thr | Gly | Cys | Lys |
| Ala | Ala | Cys | Cys | Glu | Val | Cys | Cys | Thr | Pro | Ala | Cys | Thr | Gly | Cys | Tyr |
| Ala | Ala | Cys | Cys | Glu | Val | Cys | Cys | Thr | Pro | Ala | Cys | Thr | Gly | D-Cys | — |
| Ala | Ala | Cys | Cys | Glu | Val | Cys | Cys | Thr | Pro | Ala | Cys | Thr | Gly | D-Cys | Lys |
| Ala | Ala | Cys | Cys | Glu | Val | Cys | Cys | Thr | Pro | Ala | Cys | Thr | Gly | D-Cys | Tyr |
| Ala | Ala | Cys | Cys | Glu | Val | D-Cys | Cys | Asn | Pro | Ala | Cys | Thr | Gly | Cys | — |
| Ala | Ala | Cys | Cys | Glu | Val | D-Cys | Cys | Asn | Pro | Ala | Cys | Thr | Gly | Cys | Lys |
| Ala | Ala | Cys | Cys | Glu | Val | D-Cys | Cys | Asn | Pro | Ala | Cys | Thr | Gly | Cys | Tyr |
| Ala | Ala | Cys | Cys | Glu | Val | D-Cys | Cys | Asn | Pro | Ala | Cys | Thr | Gly | D-Cys | — |
| Ala | Ala | Cys | Cys | Glu | Val | D-Cys | Cys | Asn | Pro | Ala | Cys | Thr | Gly | D-Cys | Lys |
| Ala | Ala | Cys | Cys | Glu | Val | D-Cys | Cys | Asn | Pro | Ala | Cys | Thr | Gly | D-Cys | Tyr |
| Ala | Ala | Cys | Cys | Glu | Val | D-Cys | Cys | Thr | Pro | Ala | Cys | Thr | Gly | Cys | — |
| Ala | Ala | Cys | Cys | Glu | Val | D-Cys | Cys | Thr | Pro | Ala | Cys | Thr | Gly | Cys | Lys |
| Ala | Ala | Cys | Cys | Glu | Val | D-Cys | Cys | Thr | Pro | Ala | Cys | Thr | Gly | Cys | Tyr |
| Ala | Ala | Cys | Cys | Glu | Val | D-Cys | Cys | Thr | Pro | Ala | Cys | Thr | Gly | D-Cys | — |
| Ala | Ala | Cys | Cys | Glu | Val | D-Cys | Cys | Thr | Pro | Ala | Cys | Thr | Gly | D-Cys | Lys |
| Ala | Ala | Cys | Cys | Glu | Val | D-Cys | Cys | Thr | Pro | Ala | Cys | Thr | Gly | D-Cys | Tyr |
| Ala | Ala | Cys | Cys | Glu | Ile | Cys | Cys | Asn | Pro | Ala | Cys | Thr | Gly | Cys | — |
| Ala | Ala | Cys | Cys | Glu | Ile | Cys | Cys | Asn | Pro | Ala | Cys | Thr | Gly | Cys | Lys |
| Ala | Ala | Cys | Cys | Glu | Ile | Cys | Cys | Asn | Pro | Ala | Cys | Thr | Gly | Cys | Tyr |

FIG. 3A-34

| Ala | Ala | Cys | Cys | Glu | Ile | Cys | Cys | Asn | Pro | Ala | Cys | Thr | Gly | D-Cys | — |
|---|---|---|---|---|---|---|---|---|---|---|---|---|---|---|---|
| Ala | Ala | Cys | Cys | Glu | Ile | Cys | Cys | Asn | Pro | Ala | Cys | Thr | Gly | D-Cys | Lys |
| Ala | Ala | Cys | Cys | Glu | Ile | Cys | Cys | Asn | Pro | Ala | Cys | Thr | Gly | D-Cys | Tyr |
| Ala | Ala | Cys | Cys | Glu | Ile | Cys | Cys | Thr | Pro | Ala | Cys | Thr | Gly | Cys | — |
| Ala | Ala | Cys | Cys | Glu | Ile | Cys | Cys | Thr | Pro | Ala | Cys | Thr | Gly | Cys | Lys |
| Ala | Ala | Cys | Cys | Glu | Ile | Cys | Cys | Thr | Pro | Ala | Cys | Thr | Gly | Cys | Tyr |
| Ala | Ala | Cys | Cys | Glu | Ile | Cys | Cys | Thr | Pro | Ala | Cys | Thr | Gly | D-Cys | — |
| Ala | Ala | Cys | Cys | Glu | Ile | Cys | Cys | Thr | Pro | Ala | Cys | Thr | Gly | D-Cys | Lys |
| Ala | Ala | Cys | Cys | Glu | Ile | Cys | Cys | Thr | Pro | Ala | Cys | Thr | Gly | D-Cys | Tyr |
| Ala | Ala | Cys | Cys | Glu | Ile | D-Cys | Cys | Asn | Pro | Ala | Cys | Thr | Gly | Cys | — |
| Ala | Ala | Cys | Cys | Glu | Ile | D-Cys | Cys | Asn | Pro | Ala | Cys | Thr | Gly | Cys | Lys |
| Ala | Ala | Cys | Cys | Glu | Ile | D-Cys | Cys | Asn | Pro | Ala | Cys | Thr | Gly | Cys | Tyr |
| Ala | Ala | Cys | Cys | Glu | Ile | D-Cys | Cys | Asn | Pro | Ala | Cys | Thr | Gly | D-Cys | — |
| Ala | Ala | Cys | Cys | Glu | Ile | D-Cys | Cys | Asn | Pro | Ala | Cys | Thr | Gly | D-Cys | Lys |
| Ala | Ala | Cys | Cys | Glu | Ile | D-Cys | Cys | Asn | Pro | Ala | Cys | Thr | Gly | D-Cys | Tyr |
| Ala | Ala | Cys | Cys | Glu | Ile | D-Cys | Cys | Thr | Pro | Ala | Cys | Thr | Gly | Cys | — |
| Ala | Ala | Cys | Cys | Glu | Ile | D-Cys | Cys | Thr | Pro | Ala | Cys | Thr | Gly | Cys | Lys |
| Ala | Ala | Cys | Cys | Glu | Ile | D-Cys | Cys | Thr | Pro | Ala | Cys | Thr | Gly | Cys | Tyr |
| Ala | Ala | Cys | Cys | Glu | Ile | D-Cys | Cys | Thr | Pro | Ala | Cys | Thr | Gly | D-Cys | — |
| Ala | Ala | Cys | Cys | Glu | Ile | D-Cys | Cys | Thr | Pro | Ala | Cys | Thr | Gly | D-Cys | Lys |
| Ala | Ala | Cys | Cys | Glu | Ile | D-Cys | Cys | Thr | Pro | Ala | Cys | Thr | Gly | D-Cys | Tyr |
| Ala | Ala | Cys | Cys | Glu | Leu | Cys | Cys | Asn | Pro | Ala | Cys | Thr | Gly | Cys | — |
| Ala | Ala | Cys | Cys | Glu | Leu | Cys | Cys | Asn | Pro | Ala | Cys | Thr | Gly | Cys | Lys |
| Ala | Ala | Cys | Cys | Glu | Leu | Cys | Cys | Asn | Pro | Ala | Cys | Thr | Gly | Cys | Tyr |
| Ala | Ala | Cys | Cys | Glu | Leu | Cys | Cys | Asn | Pro | Ala | Cys | Thr | Gly | D-Cys | — |
| Ala | Ala | Cys | Cys | Glu | Leu | Cys | Cys | Asn | Pro | Ala | Cys | Thr | Gly | D-Cys | Lys |
| Ala | Ala | Cys | Cys | Glu | Leu | Cys | Cys | Asn | Pro | Ala | Cys | Thr | Gly | D-Cys | Tyr |
| Ala | Ala | Cys | Cys | Glu | Leu | Cys | Cys | Thr | Pro | Ala | Cys | Thr | Gly | Cys | — |
| Ala | Ala | Cys | Cys | Glu | Leu | Cys | Cys | Thr | Pro | Ala | Cys | Thr | Gly | Cys | Lys |
| Ala | Ala | Cys | Cys | Glu | Leu | Cys | Cys | Thr | Pro | Ala | Cys | Thr | Gly | Cys | Tyr |
| Ala | Ala | Cys | Cys | Glu | Leu | Cys | Cys | Thr | Pro | Ala | Cys | Thr | Gly | D-Cys | — |
| Ala | Ala | Cys | Cys | Glu | Leu | Cys | Cys | Thr | Pro | Ala | Cys | Thr | Gly | D-Cys | Lys |
| Ala | Ala | Cys | Cys | Glu | Leu | Cys | Cys | Thr | Pro | Ala | Cys | Thr | Gly | D-Cys | Tyr |
| Ala | Ala | Cys | Cys | Glu | Leu | D-Cys | Cys | Asn | Pro | Ala | Cys | Thr | Gly | Cys | — |
| Ala | Ala | Cys | Cys | Glu | Leu | D-Cys | Cys | Asn | Pro | Ala | Cys | Thr | Gly | Cys | Lys |
| Ala | Ala | Cys | Cys | Glu | Leu | D-Cys | Cys | Asn | Pro | Ala | Cys | Thr | Gly | Cys | Tyr |
| Ala | Ala | Cys | Cys | Glu | Leu | D-Cys | Cys | Asn | Pro | Ala | Cys | Thr | Gly | D-Cys | — |
| Ala | Ala | Cys | Cys | Glu | Leu | D-Cys | Cys | Asn | Pro | Ala | Cys | Thr | Gly | D-Cys | Lys |
| Ala | Ala | Cys | Cys | Glu | Leu | D-Cys | Cys | Asn | Pro | Ala | Cys | Thr | Gly | D-Cys | Tyr |
| Ala | Ala | Cys | Cys | Glu | Leu | D-Cys | Cys | Thr | Pro | Ala | Cys | Thr | Gly | Cys | — |
| Ala | Ala | Cys | Cys | Glu | Leu | D-Cys | Cys | Thr | Pro | Ala | Cys | Thr | Gly | Cys | Lys |
| Ala | Ala | Cys | Cys | Glu | Leu | D-Cys | Cys | Thr | Pro | Ala | Cys | Thr | Gly | Cys | Tyr |
| Ala | Ala | Cys | Cys | Glu | Leu | D-Cys | Cys | Thr | Pro | Ala | Cys | Thr | Gly | D-Cys | — |
| Ala | Ala | Cys | Cys | Glu | Leu | D-Cys | Cys | Thr | Pro | Ala | Cys | Thr | Gly | D-Cys | Lys |
| Ala | Ala | Cys | Cys | Glu | Leu | D-Cys | Cys | Thr | Pro | Ala | Cys | Thr | Gly | D-Cys | Tyr |
| Ala | Ala | Cys | Cys | Glu | Tyr | Cys | Cys | Asn | Pro | Ala | Cys | Thr | Gly | Cys | — |
| Ala | Ala | Cys | Cys | Glu | Tyr | Cys | Cys | Asn | Pro | Ala | Cys | Thr | Gly | Cys | Lys |
| Ala | Ala | Cys | Cys | Glu | Tyr | Cys | Cys | Asn | Pro | Ala | Cys | Thr | Gly | Cys | Tyr |
| Ala | Ala | Cys | Cys | Glu | Tyr | Cys | Cys | Asn | Pro | Ala | Cys | Thr | Gly | D-Cys | — |
| Ala | Ala | Cys | Cys | Glu | Tyr | Cys | Cys | Asn | Pro | Ala | Cys | Thr | Gly | D-Cys | Lys |
| Ala | Ala | Cys | Cys | Glu | Tyr | Cys | Cys | Asn | Pro | Ala | Cys | Thr | Gly | D-Cys | Tyr |
| Ala | Ala | Cys | Cys | Glu | Tyr | Cys | Cys | Thr | Pro | Ala | Cys | Thr | Gly | Cys | — |
| Ala | Ala | Cys | Cys | Glu | Tyr | Cys | Cys | Thr | Pro | Ala | Cys | Thr | Gly | Cys | Lys |
| Ala | Ala | Cys | Cys | Glu | Tyr | Cys | Cys | Thr | Pro | Ala | Cys | Thr | Gly | Cys | Tyr |
| Ala | Ala | Cys | Cys | Glu | Tyr | Cys | Cys | Thr | Pro | Ala | Cys | Thr | Gly | D-Cys | — |
| Ala | Ala | Cys | Cys | Glu | Tyr | Cys | Cys | Thr | Pro | Ala | Cys | Thr | Gly | D-Cys | Lys |
| Ala | Ala | Cys | Cys | Glu | Tyr | Cys | Cys | Thr | Pro | Ala | Cys | Thr | Gly | D-Cys | Tyr |
| Ala | Ala | Cys | Cys | Glu | Tyr | D-Cys | Cys | Asn | Pro | Ala | Cys | Thr | Gly | Cys | — |
| Ala | Ala | Cys | Cys | Glu | Tyr | D-Cys | Cys | Asn | Pro | Ala | Cys | Thr | Gly | Cys | Lys |
| Ala | Ala | Cys | Cys | Glu | Tyr | D-Cys | Cys | Asn | Pro | Ala | Cys | Thr | Gly | Cys | Tyr |

FIG. 3A-35

| | | | | | | | | | | | | | | | |
|---|---|---|---|---|---|---|---|---|---|---|---|---|---|---|---|
| Ala | Ala | Cys | Cys | Glu | Tyr | D-Cys | Cys | Asn | Pro | Ala | Cys | Thr | Gly | D-Cys | — |
| Ala | Ala | Cys | Cys | Glu | Tyr | D-Cys | Cys | Asn | Pro | Ala | Cys | Thr | Gly | D-Cys | Lys |
| Ala | Ala | Cys | Cys | Glu | Tyr | D-Cys | Cys | Asn | Pro | Ala | Cys | Thr | Gly | D-Cys | Tyr |
| Ala | Ala | Cys | Cys | Glu | Tyr | D-Cys | Cys | Thr | Pro | Ala | Cys | Thr | Gly | Cys | — |
| Ala | Ala | Cys | Cys | Glu | Tyr | D-Cys | Cys | Thr | Pro | Ala | Cys | Thr | Gly | Cys | Lys |
| Ala | Ala | Cys | Cys | Glu | Tyr | D-Cys | Cys | Thr | Pro | Ala | Cys | Thr | Gly | Cys | Tyr |
| Ala | Ala | Cys | Cys | Glu | Tyr | D-Cys | Cys | Thr | Pro | Ala | Cys | Thr | Gly | D-Cys | — |
| Ala | Ala | Cys | Cys | Glu | Tyr | D-Cys | Cys | Thr | Pro | Ala | Cys | Thr | Gly | D-Cys | Lys |
| Ala | Ala | Cys | Cys | Glu | Tyr | D-Cys | Cys | Thr | Pro | Ala | Cys | Thr | Gly | D-Cys | Tyr |
| Ala | Ala | Cys | Cys | Glu | Phe | Cys | Cys | Asn | Pro | Ala | Cys | Thr | Gly | Cys | — |
| Ala | Ala | Cys | Cys | Glu | Phe | Cys | Cys | Asn | Pro | Ala | Cys | Thr | Gly | Cys | Lys |
| Ala | Ala | Cys | Cys | Glu | Phe | Cys | Cys | Asn | Pro | Ala | Cys | Thr | Gly | Cys | Tyr |
| Ala | Ala | Cys | Cys | Glu | Phe | Cys | Cys | Asn | Pro | Ala | Cys | Thr | Gly | D-Cys | — |
| Ala | Ala | Cys | Cys | Glu | Phe | Cys | Cys | Asn | Pro | Ala | Cys | Thr | Gly | D-Cys | Lys |
| Ala | Ala | Cys | Cys | Glu | Phe | Cys | Cys | Asn | Pro | Ala | Cys | Thr | Gly | D-Cys | Tyr |
| Ala | Ala | Cys | Cys | Glu | Phe | Cys | Cys | Thr | Pro | Ala | Cys | Thr | Gly | Cys | — |
| Ala | Ala | Cys | Cys | Glu | Phe | Cys | Cys | Thr | Pro | Ala | Cys | Thr | Gly | Cys | Lys |
| Ala | Ala | Cys | Cys | Glu | Phe | Cys | Cys | Thr | Pro | Ala | Cys | Thr | Gly | Cys | Tyr |
| Ala | Ala | Cys | Cys | Glu | Phe | Cys | Cys | Thr | Pro | Ala | Cys | Thr | Gly | D-Cys | — |
| Ala | Ala | Cys | Cys | Glu | Phe | Cys | Cys | Thr | Pro | Ala | Cys | Thr | Gly | D-Cys | Lys |
| Ala | Ala | Cys | Cys | Glu | Phe | Cys | Cys | Thr | Pro | Ala | Cys | Thr | Gly | D-Cys | Tyr |
| Ala | Ala | Cys | Cys | Glu | Phe | D-Cys | Cys | Asn | Pro | Ala | Cys | Thr | Gly | Cys | — |
| Ala | Ala | Cys | Cys | Glu | Phe | D-Cys | Cys | Asn | Pro | Ala | Cys | Thr | Gly | Cys | Lys |
| Ala | Ala | Cys | Cys | Glu | Phe | D-Cys | Cys | Asn | Pro | Ala | Cys | Thr | Gly | Cys | Tyr |
| Ala | Ala | Cys | Cys | Glu | Phe | D-Cys | Cys | Asn | Pro | Ala | Cys | Thr | Gly | D-Cys | — |
| Ala | Ala | Cys | Cys | Glu | Phe | D-Cys | Cys | Asn | Pro | Ala | Cys | Thr | Gly | D-Cys | Lys |
| Ala | Ala | Cys | Cys | Glu | Phe | D-Cys | Cys | Asn | Pro | Ala | Cys | Thr | Gly | D-Cys | Tyr |
| Ala | Ala | Cys | Cys | Glu | Phe | D-Cys | Cys | Thr | Pro | Ala | Cys | Thr | Gly | Cys | — |
| Ala | Ala | Cys | Cys | Glu | Phe | D-Cys | Cys | Thr | Pro | Ala | Cys | Thr | Gly | Cys | Lys |
| Ala | Ala | Cys | Cys | Glu | Phe | D-Cys | Cys | Thr | Pro | Ala | Cys | Thr | Gly | Cys | Tyr |
| Ala | Ala | Cys | Cys | Glu | Phe | D-Cys | Cys | Thr | Pro | Ala | Cys | Thr | Gly | D-Cys | — |
| Ala | Ala | Cys | Cys | Glu | Phe | D-Cys | Cys | Thr | Pro | Ala | Cys | Thr | Gly | D-Cys | Lys |
| Ala | Ala | Cys | Cys | Glu | Phe | D-Cys | Cys | Thr | Pro | Ala | Cys | Thr | Gly | D-Cys | Tyr |
| Ala | Ala | Cys | Cys | Glu | Trp | Cys | Cys | Asn | Pro | Ala | Cys | Thr | Gly | Cys | — |
| Ala | Ala | Cys | Cys | Glu | Trp | Cys | Cys | Asn | Pro | Ala | Cys | Thr | Gly | Cys | Lys |
| Ala | Ala | Cys | Cys | Glu | Trp | Cys | Cys | Asn | Pro | Ala | Cys | Thr | Gly | Cys | Tyr |
| Ala | Ala | Cys | Cys | Glu | Trp | Cys | Cys | Asn | Pro | Ala | Cys | Thr | Gly | D-Cys | — |
| Ala | Ala | Cys | Cys | Glu | Trp | Cys | Cys | Asn | Pro | Ala | Cys | Thr | Gly | D-Cys | Lys |
| Ala | Ala | Cys | Cys | Glu | Trp | Cys | Cys | Asn | Pro | Ala | Cys | Thr | Gly | D-Cys | Tyr |
| Ala | Ala | Cys | Cys | Glu | Trp | Cys | Cys | Thr | Pro | Ala | Cys | Thr | Gly | Cys | — |
| Ala | Ala | Cys | Cys | Glu | Trp | Cys | Cys | Thr | Pro | Ala | Cys | Thr | Gly | Cys | Lys |
| Ala | Ala | Cys | Cys | Glu | Trp | Cys | Cys | Thr | Pro | Ala | Cys | Thr | Gly | Cys | Tyr |
| Ala | Ala | Cys | Cys | Glu | Trp | Cys | Cys | Thr | Pro | Ala | Cys | Thr | Gly | D-Cys | — |
| Ala | Ala | Cys | Cys | Glu | Trp | Cys | Cys | Thr | Pro | Ala | Cys | Thr | Gly | D-Cys | Lys |
| Ala | Ala | Cys | Cys | Glu | Trp | Cys | Cys | Thr | Pro | Ala | Cys | Thr | Gly | D-Cys | Tyr |
| Ala | Ala | Cys | Cys | Glu | Trp | D-Cys | Cys | Asn | Pro | Ala | Cys | Thr | Gly | Cys | — |
| Ala | Ala | Cys | Cys | Glu | Trp | D-Cys | Cys | Asn | Pro | Ala | Cys | Thr | Gly | Cys | Lys |
| Ala | Ala | Cys | Cys | Glu | Trp | D-Cys | Cys | Asn | Pro | Ala | Cys | Thr | Gly | Cys | Tyr |
| Ala | Ala | Cys | Cys | Glu | Trp | D-Cys | Cys | Asn | Pro | Ala | Cys | Thr | Gly | D-Cys | — |
| Ala | Ala | Cys | Cys | Glu | Trp | D-Cys | Cys | Asn | Pro | Ala | Cys | Thr | Gly | D-Cys | Lys |
| Ala | Ala | Cys | Cys | Glu | Trp | D-Cys | Cys | Asn | Pro | Ala | Cys | Thr | Gly | D-Cys | Tyr |
| Ala | Ala | Cys | Cys | Glu | Trp | D-Cys | Cys | Thr | Pro | Ala | Cys | Thr | Gly | Cys | — |
| Ala | Ala | Cys | Cys | Glu | Trp | D-Cys | Cys | Thr | Pro | Ala | Cys | Thr | Gly | Cys | Lys |
| Ala | Ala | Cys | Cys | Glu | Trp | D-Cys | Cys | Thr | Pro | Ala | Cys | Thr | Gly | Cys | Tyr |
| Ala | Ala | Cys | Cys | Glu | Trp | D-Cys | Cys | Thr | Pro | Ala | Cys | Thr | Gly | D-Cys | — |
| Ala | Ala | Cys | Cys | Glu | Trp | D-Cys | Cys | Thr | Pro | Ala | Cys | Thr | Gly | D-Cys | Lys |
| Ala | Ala | Cys | Cys | Glu | Trp | D-Cys | Cys | Thr | Pro | Ala | Cys | Thr | Gly | D-Cys | Tyr |
| Ala | Ala | D-Cys | Cys | Glu | Val | Cys | Cys | Asn | Pro | Ala | Cys | Thr | Gly | Cys | — |
| Ala | Ala | D-Cys | Cys | Glu | Val | Cys | Cys | Asn | Pro | Ala | Cys | Thr | Gly | Cys | Lys |
| Ala | Ala | D-Cys | Cys | Glu | Val | Cys | Cys | Asn | Pro | Ala | Cys | Thr | Gly | Cys | Tyr |

FIG. 3A-36

| Ala | Ala | D-Cys | Cys | Glu | Val | Cys | Cys | Asn | Pro | Ala | Cys | Thr | Gly | D-Cys | — |
|---|---|---|---|---|---|---|---|---|---|---|---|---|---|---|---|
| Ala | Ala | D-Cys | Cys | Glu | Val | Cys | Cys | Asn | Pro | Ala | Cys | Thr | Gly | D-Cys | Lys |
| Ala | Ala | D-Cys | Cys | Glu | Val | Cys | Cys | Asn | Pro | Ala | Cys | Thr | Gly | D-Cys | Tyr |
| Ala | Ala | D-Cys | Cys | Glu | Val | Cys | Cys | Thr | Pro | Ala | Cys | Thr | Gly | Cys | — |
| Ala | Ala | D-Cys | Cys | Glu | Val | Cys | Cys | Thr | Pro | Ala | Cys | Thr | Gly | Cys | Lys |
| Ala | Ala | D-Cys | Cys | Glu | Val | Cys | Cys | Thr | Pro | Ala | Cys | Thr | Gly | Cys | Tyr |
| Ala | Ala | D-Cys | Cys | Glu | Val | Cys | Cys | Thr | Pro | Ala | Cys | Thr | Gly | D-Cys | — |
| Ala | Ala | D-Cys | Cys | Glu | Val | Cys | Cys | Thr | Pro | Ala | Cys | Thr | Gly | D-Cys | Lys |
| Ala | Ala | D-Cys | Cys | Glu | Val | Cys | Cys | Thr | Pro | Ala | Cys | Thr | Gly | D-Cys | Tyr |
| Ala | Ala | D-Cys | Cys | Glu | Val | D-Cys | Cys | Asn | Pro | Ala | Cys | Thr | Gly | Cys | — |
| Ala | Ala | D-Cys | Cys | Glu | Val | D-Cys | Cys | Asn | Pro | Ala | Cys | Thr | Gly | Cys | Lys |
| Ala | Ala | D-Cys | Cys | Glu | Val | D-Cys | Cys | Asn | Pro | Ala | Cys | Thr | Gly | Cys | Tyr |
| Ala | Ala | D-Cys | Cys | Glu | Val | D-Cys | Cys | Asn | Pro | Ala | Cys | Thr | Gly | D-Cys | — |
| Ala | Ala | D-Cys | Cys | Glu | Val | D-Cys | Cys | Asn | Pro | Ala | Cys | Thr | Gly | D-Cys | Lys |
| Ala | Ala | D-Cys | Cys | Glu | Val | D-Cys | Cys | Asn | Pro | Ala | Cys | Thr | Gly | D-Cys | Tyr |
| Ala | Ala | D-Cys | Cys | Glu | Val | D-Cys | Cys | Thr | Pro | Ala | Cys | Thr | Gly | Cys | — |
| Ala | Ala | D-Cys | Cys | Glu | Val | D-Cys | Cys | Thr | Pro | Ala | Cys | Thr | Gly | Cys | Lys |
| Ala | Ala | D-Cys | Cys | Glu | Val | D-Cys | Cys | Thr | Pro | Ala | Cys | Thr | Gly | Cys | Tyr |
| Ala | Ala | D-Cys | Cys | Glu | Val | D-Cys | Cys | Thr | Pro | Ala | Cys | Thr | Gly | D-Cys | — |
| Ala | Ala | D-Cys | Cys | Glu | Val | D-Cys | Cys | Thr | Pro | Ala | Cys | Thr | Gly | D-Cys | Lys |
| Ala | Ala | D-Cys | Cys | Glu | Val | D-Cys | Cys | Thr | Pro | Ala | Cys | Thr | Gly | D-Cys | Tyr |
| Ala | Ala | D-Cys | Cys | Glu | Ile | Cys | Cys | Asn | Pro | Ala | Cys | Thr | Gly | Cys | — |
| Ala | Ala | D-Cys | Cys | Glu | Ile | Cys | Cys | Asn | Pro | Ala | Cys | Thr | Gly | Cys | Lys |
| Ala | Ala | D-Cys | Cys | Glu | Ile | Cys | Cys | Asn | Pro | Ala | Cys | Thr | Gly | Cys | Tyr |
| Ala | Ala | D-Cys | Cys | Glu | Ile | Cys | Cys | Asn | Pro | Ala | Cys | Thr | Gly | D-Cys | — |
| Ala | Ala | D-Cys | Cys | Glu | Ile | Cys | Cys | Asn | Pro | Ala | Cys | Thr | Gly | D-Cys | Lys |
| Ala | Ala | D-Cys | Cys | Glu | Ile | Cys | Cys | Asn | Pro | Ala | Cys | Thr | Gly | D-Cys | Tyr |
| Ala | Ala | D-Cys | Cys | Glu | Ile | Cys | Cys | Thr | Pro | Ala | Cys | Thr | Gly | Cys | — |
| Ala | Ala | D-Cys | Cys | Glu | Ile | Cys | Cys | Thr | Pro | Ala | Cys | Thr | Gly | Cys | Lys |
| Ala | Ala | D-Cys | Cys | Glu | Ile | Cys | Cys | Thr | Pro | Ala | Cys | Thr | Gly | Cys | Tyr |
| Ala | Ala | D-Cys | Cys | Glu | Ile | Cys | Cys | Thr | Pro | Ala | Cys | Thr | Gly | D-Cys | — |
| Ala | Ala | D-Cys | Cys | Glu | Ile | Cys | Cys | Thr | Pro | Ala | Cys | Thr | Gly | D-Cys | Lys |
| Ala | Ala | D-Cys | Cys | Glu | Ile | Cys | Cys | Thr | Pro | Ala | Cys | Thr | Gly | D-Cys | Tyr |
| Ala | Ala | D-Cys | Cys | Glu | Ile | D-Cys | Cys | Asn | Pro | Ala | Cys | Thr | Gly | Cys | — |
| Ala | Ala | D-Cys | Cys | Glu | Ile | D-Cys | Cys | Asn | Pro | Ala | Cys | Thr | Gly | Cys | Lys |
| Ala | Ala | D-Cys | Cys | Glu | Ile | D-Cys | Cys | Asn | Pro | Ala | Cys | Thr | Gly | Cys | Tyr |
| Ala | Ala | D-Cys | Cys | Glu | Ile | D-Cys | Cys | Asn | Pro | Ala | Cys | Thr | Gly | D-Cys | — |
| Ala | Ala | D-Cys | Cys | Glu | Ile | D-Cys | Cys | Asn | Pro | Ala | Cys | Thr | Gly | D-Cys | Lys |
| Ala | Ala | D-Cys | Cys | Glu | Ile | D-Cys | Cys | Asn | Pro | Ala | Cys | Thr | Gly | D-Cys | Tyr |
| Ala | Ala | D-Cys | Cys | Glu | Ile | D-Cys | Cys | Thr | Pro | Ala | Cys | Thr | Gly | Cys | — |
| Ala | Ala | D-Cys | Cys | Glu | Ile | D-Cys | Cys | Thr | Pro | Ala | Cys | Thr | Gly | Cys | Lys |
| Ala | Ala | D-Cys | Cys | Glu | Ile | D-Cys | Cys | Thr | Pro | Ala | Cys | Thr | Gly | Cys | Tyr |
| Ala | Ala | D-Cys | Cys | Glu | Ile | D-Cys | Cys | Thr | Pro | Ala | Cys | Thr | Gly | D-Cys | — |
| Ala | Ala | D-Cys | Cys | Glu | Ile | D-Cys | Cys | Thr | Pro | Ala | Cys | Thr | Gly | D-Cys | Lys |
| Ala | Ala | D-Cys | Cys | Glu | Ile | D-Cys | Cys | Thr | Pro | Ala | Cys | Thr | Gly | D-Cys | Tyr |
| Ala | Ala | D-Cys | Cys | Glu | Leu | Cys | Cys | Asn | Pro | Ala | Cys | Thr | Gly | Cys | — |
| Ala | Ala | D-Cys | Cys | Glu | Leu | Cys | Cys | Asn | Pro | Ala | Cys | Thr | Gly | Cys | Lys |
| Ala | Ala | D-Cys | Cys | Glu | Leu | Cys | Cys | Asn | Pro | Ala | Cys | Thr | Gly | Cys | Tyr |
| Ala | Ala | D-Cys | Cys | Glu | Leu | Cys | Cys | Asn | Pro | Ala | Cys | Thr | Gly | D-Cys | — |
| Ala | Ala | D-Cys | Cys | Glu | Leu | Cys | Cys | Asn | Pro | Ala | Cys | Thr | Gly | D-Cys | Lys |
| Ala | Ala | D-Cys | Cys | Glu | Leu | Cys | Cys | Asn | Pro | Ala | Cys | Thr | Gly | D-Cys | Tyr |
| Ala | Ala | D-Cys | Cys | Glu | Leu | Cys | Cys | Thr | Pro | Ala | Cys | Thr | Gly | Cys | — |
| Ala | Ala | D-Cys | Cys | Glu | Leu | Cys | Cys | Thr | Pro | Ala | Cys | Thr | Gly | Cys | Lys |
| Ala | Ala | D-Cys | Cys | Glu | Leu | Cys | Cys | Thr | Pro | Ala | Cys | Thr | Gly | Cys | Tyr |
| Ala | Ala | D-Cys | Cys | Glu | Leu | Cys | Cys | Thr | Pro | Ala | Cys | Thr | Gly | D-Cys | — |
| Ala | Ala | D-Cys | Cys | Glu | Leu | Cys | Cys | Thr | Pro | Ala | Cys | Thr | Gly | D-Cys | Lys |
| Ala | Ala | D-Cys | Cys | Glu | Leu | Cys | Cys | Thr | Pro | Ala | Cys | Thr | Gly | D-Cys | Tyr |
| Ala | Ala | D-Cys | Cys | Glu | Leu | D-Cys | Cys | Asn | Pro | Ala | Cys | Thr | Gly | Cys | — |
| Ala | Ala | D-Cys | Cys | Glu | Leu | D-Cys | Cys | Asn | Pro | Ala | Cys | Thr | Gly | Cys | Lys |
| Ala | Ala | D-Cys | Cys | Glu | Leu | D-Cys | Cys | Asn | Pro | Ala | Cys | Thr | Gly | Cys | Tyr |

FIG. 3A-37

| | | | | | | | | | | | | | | |
|---|---|---|---|---|---|---|---|---|---|---|---|---|---|---|
| Ala | Ala | D-Cys | Cys | Glu | Leu | D-Cys | Cys | Asn | Pro | Ala | Cys | Thr | Gly | D-Cys | — |
| Ala | Ala | D-Cys | Cys | Glu | Leu | D-Cys | Cys | Asn | Pro | Ala | Cys | Thr | Gly | D-Cys | Lys |
| Ala | Ala | D-Cys | Cys | Glu | Leu | D-Cys | Cys | Asn | Pro | Ala | Cys | Thr | Gly | D-Cys | Tyr |
| Ala | Ala | D-Cys | Cys | Glu | Leu | D-Cys | Cys | Thr | Pro | Ala | Cys | Thr | Gly | Cys | — |
| Ala | Ala | D-Cys | Cys | Glu | Leu | D-Cys | Cys | Thr | Pro | Ala | Cys | Thr | Gly | Cys | Lys |
| Ala | Ala | D-Cys | Cys | Glu | Leu | D-Cys | Cys | Thr | Pro | Ala | Cys | Thr | Gly | Cys | Tyr |
| Ala | Ala | D-Cys | Cys | Glu | Leu | D-Cys | Cys | Thr | Pro | Ala | Cys | Thr | Gly | D-Cys | — |
| Ala | Ala | D-Cys | Cys | Glu | Leu | D-Cys | Cys | Thr | Pro | Ala | Cys | Thr | Gly | D-Cys | Lys |
| Ala | Ala | D-Cys | Cys | Glu | Leu | D-Cys | Cys | Thr | Pro | Ala | Cys | Thr | Gly | D-Cys | Tyr |
| Ala | Ala | D-Cys | Cys | Glu | Tyr | Cys | Cys | Asn | Pro | Ala | Cys | Thr | Gly | Cys | — |
| Ala | Ala | D-Cys | Cys | Glu | Tyr | Cys | Cys | Asn | Pro | Ala | Cys | Thr | Gly | Cys | Lys |
| Ala | Ala | D-Cys | Cys | Glu | Tyr | Cys | Cys | Asn | Pro | Ala | Cys | Thr | Gly | Cys | Tyr |
| Ala | Ala | D-Cys | Cys | Glu | Tyr | Cys | Cys | Asn | Pro | Ala | Cys | Thr | Gly | D-Cys | — |
| Ala | Ala | D-Cys | Cys | Glu | Tyr | Cys | Cys | Asn | Pro | Ala | Cys | Thr | Gly | D-Cys | Lys |
| Ala | Ala | D-Cys | Cys | Glu | Tyr | Cys | Cys | Asn | Pro | Ala | Cys | Thr | Gly | D-Cys | Tyr |
| Ala | Ala | D-Cys | Cys | Glu | Tyr | Cys | Cys | Thr | Pro | Ala | Cys | Thr | Gly | Cys | — |
| Ala | Ala | D-Cys | Cys | Glu | Tyr | Cys | Cys | Thr | Pro | Ala | Cys | Thr | Gly | Cys | Lys |
| Ala | Ala | D-Cys | Cys | Glu | Tyr | Cys | Cys | Thr | Pro | Ala | Cys | Thr | Gly | Cys | Tyr |
| Ala | Ala | D-Cys | Cys | Glu | Tyr | Cys | Cys | Thr | Pro | Ala | Cys | Thr | Gly | D-Cys | — |
| Ala | Ala | D-Cys | Cys | Glu | Tyr | Cys | Cys | Thr | Pro | Ala | Cys | Thr | Gly | D-Cys | Lys |
| Ala | Ala | D-Cys | Cys | Glu | Tyr | Cys | Cys | Thr | Pro | Ala | Cys | Thr | Gly | D-Cys | Tyr |
| Ala | Ala | D-Cys | Cys | Glu | Tyr | D-Cys | Cys | Asn | Pro | Ala | Cys | Thr | Gly | Cys | — |
| Ala | Ala | D-Cys | Cys | Glu | Tyr | D-Cys | Cys | Asn | Pro | Ala | Cys | Thr | Gly | Cys | Lys |
| Ala | Ala | D-Cys | Cys | Glu | Tyr | D-Cys | Cys | Asn | Pro | Ala | Cys | Thr | Gly | Cys | Tyr |
| Ala | Ala | D-Cys | Cys | Glu | Tyr | D-Cys | Cys | Asn | Pro | Ala | Cys | Thr | Gly | D-Cys | — |
| Ala | Ala | D-Cys | Cys | Glu | Tyr | D-Cys | Cys | Asn | Pro | Ala | Cys | Thr | Gly | D-Cys | Lys |
| Ala | Ala | D-Cys | Cys | Glu | Tyr | D-Cys | Cys | Asn | Pro | Ala | Cys | Thr | Gly | D-Cys | Tyr |
| Ala | Ala | D-Cys | Cys | Glu | Tyr | D-Cys | Cys | Thr | Pro | Ala | Cys | Thr | Gly | Cys | — |
| Ala | Ala | D-Cys | Cys | Glu | Tyr | D-Cys | Cys | Thr | Pro | Ala | Cys | Thr | Gly | Cys | Lys |
| Ala | Ala | D-Cys | Cys | Glu | Tyr | D-Cys | Cys | Thr | Pro | Ala | Cys | Thr | Gly | Cys | Tyr |
| Ala | Ala | D-Cys | Cys | Glu | Tyr | D-Cys | Cys | Thr | Pro | Ala | Cys | Thr | Gly | D-Cys | — |
| Ala | Ala | D-Cys | Cys | Glu | Tyr | D-Cys | Cys | Thr | Pro | Ala | Cys | Thr | Gly | D-Cys | Lys |
| Ala | Ala | D-Cys | Cys | Glu | Tyr | D-Cys | Cys | Thr | Pro | Ala | Cys | Thr | Gly | D-Cys | Tyr |
| Ala | Ala | D-Cys | Cys | Glu | Phe | Cys | Cys | Asn | Pro | Ala | Cys | Thr | Gly | Cys | — |
| Ala | Ala | D-Cys | Cys | Glu | Phe | Cys | Cys | Asn | Pro | Ala | Cys | Thr | Gly | Cys | Lys |
| Ala | Ala | D-Cys | Cys | Glu | Phe | Cys | Cys | Asn | Pro | Ala | Cys | Thr | Gly | Cys | Tyr |
| Ala | Ala | D-Cys | Cys | Glu | Phe | Cys | Cys | Asn | Pro | Ala | Cys | Thr | Gly | D-Cys | — |
| Ala | Ala | D-Cys | Cys | Glu | Phe | Cys | Cys | Asn | Pro | Ala | Cys | Thr | Gly | D-Cys | Lys |
| Ala | Ala | D-Cys | Cys | Glu | Phe | Cys | Cys | Asn | Pro | Ala | Cys | Thr | Gly | D-Cys | Tyr |
| Ala | Ala | D-Cys | Cys | Glu | Phe | Cys | Cys | Thr | Pro | Ala | Cys | Thr | Gly | Cys | — |
| Ala | Ala | D-Cys | Cys | Glu | Phe | Cys | Cys | Thr | Pro | Ala | Cys | Thr | Gly | Cys | Lys |
| Ala | Ala | D-Cys | Cys | Glu | Phe | Cys | Cys | Thr | Pro | Ala | Cys | Thr | Gly | Cys | Tyr |
| Ala | Ala | D-Cys | Cys | Glu | Phe | Cys | Cys | Thr | Pro | Ala | Cys | Thr | Gly | D-Cys | — |
| Ala | Ala | D-Cys | Cys | Glu | Phe | Cys | Cys | Thr | Pro | Ala | Cys | Thr | Gly | D-Cys | Lys |
| Ala | Ala | D-Cys | Cys | Glu | Phe | Cys | Cys | Thr | Pro | Ala | Cys | Thr | Gly | D-Cys | Tyr |
| Ala | Ala | D-Cys | Cys | Glu | Phe | D-Cys | Cys | Asn | Pro | Ala | Cys | Thr | Gly | Cys | — |
| Ala | Ala | D-Cys | Cys | Glu | Phe | D-Cys | Cys | Asn | Pro | Ala | Cys | Thr | Gly | Cys | Lys |
| Ala | Ala | D-Cys | Cys | Glu | Phe | D-Cys | Cys | Asn | Pro | Ala | Cys | Thr | Gly | Cys | Tyr |
| Ala | Ala | D-Cys | Cys | Glu | Phe | D-Cys | Cys | Asn | Pro | Ala | Cys | Thr | Gly | D-Cys | — |
| Ala | Ala | D-Cys | Cys | Glu | Phe | D-Cys | Cys | Asn | Pro | Ala | Cys | Thr | Gly | D-Cys | Lys |
| Ala | Ala | D-Cys | Cys | Glu | Phe | D-Cys | Cys | Asn | Pro | Ala | Cys | Thr | Gly | D-Cys | Tyr |
| Ala | Ala | D-Cys | Cys | Glu | Phe | D-Cys | Cys | Thr | Pro | Ala | Cys | Thr | Gly | Cys | — |
| Ala | Ala | D-Cys | Cys | Glu | Phe | D-Cys | Cys | Thr | Pro | Ala | Cys | Thr | Gly | Cys | Lys |
| Ala | Ala | D-Cys | Cys | Glu | Phe | D-Cys | Cys | Thr | Pro | Ala | Cys | Thr | Gly | Cys | Tyr |
| Ala | Ala | D-Cys | Cys | Glu | Phe | D-Cys | Cys | Thr | Pro | Ala | Cys | Thr | Gly | D-Cys | — |
| Ala | Ala | D-Cys | Cys | Glu | Phe | D-Cys | Cys | Thr | Pro | Ala | Cys | Thr | Gly | D-Cys | Lys |
| Ala | Ala | D-Cys | Cys | Glu | Phe | D-Cys | Cys | Thr | Pro | Ala | Cys | Thr | Gly | D-Cys | Tyr |
| Ala | Ala | D-Cys | Cys | Glu | Trp | Cys | Cys | Asn | Pro | Ala | Cys | Thr | Gly | Cys | — |
| Ala | Ala | D-Cys | Cys | Glu | Trp | Cys | Cys | Asn | Pro | Ala | Cys | Thr | Gly | Cys | Lys |
| Ala | Ala | D-Cys | Cys | Glu | Trp | Cys | Cys | Asn | Pro | Ala | Cys | Thr | Gly | Cys | Tyr |

FIG. 3A-38

| | | | | | | | | | | | | | | |
|---|---|---|---|---|---|---|---|---|---|---|---|---|---|---|
| Ala | Ala | D-Cys | Cys | Glu | Trp | Cys | Cys | Asn | Pro | Ala | Cys | Thr | Gly | D-Cys | — |
| Ala | Ala | D-Cys | Cys | Glu | Trp | Cys | Cys | Asn | Pro | Ala | Cys | Thr | Gly | D-Cys | Lys |
| Ala | Ala | D-Cys | Cys | Glu | Trp | Cys | Cys | Asn | Pro | Ala | Cys | Thr | Gly | D-Cys | Tyr |
| Ala | Ala | D-Cys | Cys | Glu | Trp | Cys | Cys | Thr | Pro | Ala | Cys | Thr | Gly | Cys | — |
| Ala | Ala | D-Cys | Cys | Glu | Trp | Cys | Cys | Thr | Pro | Ala | Cys | Thr | Gly | Cys | Lys |
| Ala | Ala | D-Cys | Cys | Glu | Trp | Cys | Cys | Thr | Pro | Ala | Cys | Thr | Gly | Cys | Tyr |
| Ala | Ala | D-Cys | Cys | Glu | Trp | Cys | Cys | Thr | Pro | Ala | Cys | Thr | Gly | D-Cys | — |
| Ala | Ala | D-Cys | Cys | Glu | Trp | Cys | Cys | Thr | Pro | Ala | Cys | Thr | Gly | D-Cys | Lys |
| Ala | Ala | D-Cys | Cys | Glu | Trp | Cys | Cys | Thr | Pro | Ala | Cys | Thr | Gly | D-Cys | Tyr |
| Ala | Ala | D-Cys | Cys | Glu | Trp | D-Cys | Cys | Asn | Pro | Ala | Cys | Thr | Gly | Cys | — |
| Ala | Ala | D-Cys | Cys | Glu | Trp | D-Cys | Cys | Asn | Pro | Ala | Cys | Thr | Gly | Cys | Lys |
| Ala | Ala | D-Cys | Cys | Glu | Trp | D-Cys | Cys | Asn | Pro | Ala | Cys | Thr | Gly | Cys | Tyr |
| Ala | Ala | D-Cys | Cys | Glu | Trp | D-Cys | Cys | Asn | Pro | Ala | Cys | Thr | Gly | D-Cys | — |
| Ala | Ala | D-Cys | Cys | Glu | Trp | D-Cys | Cys | Asn | Pro | Ala | Cys | Thr | Gly | D-Cys | Lys |
| Ala | Ala | D-Cys | Cys | Glu | Trp | D-Cys | Cys | Asn | Pro | Ala | Cys | Thr | Gly | D-Cys | Tyr |
| Ala | Ala | D-Cys | Cys | Glu | Trp | D-Cys | Cys | Thr | Pro | Ala | Cys | Thr | Gly | Cys | — |
| Ala | Ala | D-Cys | Cys | Glu | Trp | D-Cys | Cys | Thr | Pro | Ala | Cys | Thr | Gly | Cys | Lys |
| Ala | Ala | D-Cys | Cys | Glu | Trp | D-Cys | Cys | Thr | Pro | Ala | Cys | Thr | Gly | Cys | Tyr |
| Ala | Ala | D-Cys | Cys | Glu | Trp | D-Cys | Cys | Thr | Pro | Ala | Cys | Thr | Gly | D-Cys | — |
| Ala | Ala | D-Cys | Cys | Glu | Trp | D-Cys | Cys | Thr | Pro | Ala | Cys | Thr | Gly | D-Cys | Lys |
| Ala | Ala | D-Cys | Cys | Glu | Trp | D-Cys | Cys | Thr | Pro | Ala | Cys | Thr | Gly | D-Cys | Tyr |
| Ala | Gly | Cys | Cys | Glu | Val | Cys | Cys | Asn | Pro | Ala | Cys | Thr | Gly | Cys | — |
| Ala | Gly | Cys | Cys | Glu | Val | Cys | Cys | Asn | Pro | Ala | Cys | Thr | Gly | Cys | Lys |
| Ala | Gly | Cys | Cys | Glu | Val | Cys | Cys | Asn | Pro | Ala | Cys | Thr | Gly | Cys | Tyr |
| Ala | Gly | Cys | Cys | Glu | Val | Cys | Cys | Asn | Pro | Ala | Cys | Thr | Gly | D-Cys | — |
| Ala | Gly | Cys | Cys | Glu | Val | Cys | Cys | Asn | Pro | Ala | Cys | Thr | Gly | D-Cys | Lys |
| Ala | Gly | Cys | Cys | Glu | Val | Cys | Cys | Asn | Pro | Ala | Cys | Thr | Gly | D-Cys | Tyr |
| Ala | Gly | Cys | Cys | Glu | Val | Cys | Cys | Thr | Pro | Ala | Cys | Thr | Gly | Cys | — |
| Ala | Gly | Cys | Cys | Glu | Val | Cys | Cys | Thr | Pro | Ala | Cys | Thr | Gly | Cys | Lys |
| Ala | Gly | Cys | Cys | Glu | Val | Cys | Cys | Thr | Pro | Ala | Cys | Thr | Gly | Cys | Tyr |
| Ala | Gly | Cys | Cys | Glu | Val | Cys | Cys | Thr | Pro | Ala | Cys | Thr | Gly | D-Cys | — |
| Ala | Gly | Cys | Cys | Glu | Val | Cys | Cys | Thr | Pro | Ala | Cys | Thr | Gly | D-Cys | Lys |
| Ala | Gly | Cys | Cys | Glu | Val | Cys | Cys | Thr | Pro | Ala | Cys | Thr | Gly | D-Cys | Tyr |
| Ala | Gly | Cys | Cys | Glu | Val | D-Cys | Cys | Asn | Pro | Ala | Cys | Thr | Gly | Cys | — |
| Ala | Gly | Cys | Cys | Glu | Val | D-Cys | Cys | Asn | Pro | Ala | Cys | Thr | Gly | Cys | Lys |
| Ala | Gly | Cys | Cys | Glu | Val | D-Cys | Cys | Asn | Pro | Ala | Cys | Thr | Gly | Cys | Tyr |
| Ala | Gly | Cys | Cys | Glu | Val | D-Cys | Cys | Asn | Pro | Ala | Cys | Thr | Gly | D-Cys | — |
| Ala | Gly | Cys | Cys | Glu | Val | D-Cys | Cys | Asn | Pro | Ala | Cys | Thr | Gly | D-Cys | Lys |
| Ala | Gly | Cys | Cys | Glu | Val | D-Cys | Cys | Asn | Pro | Ala | Cys | Thr | Gly | D-Cys | Tyr |
| Ala | Gly | Cys | Cys | Glu | Val | D-Cys | Cys | Thr | Pro | Ala | Cys | Thr | Gly | Cys | — |
| Ala | Gly | Cys | Cys | Glu | Val | D-Cys | Cys | Thr | Pro | Ala | Cys | Thr | Gly | Cys | Lys |
| Ala | Gly | Cys | Cys | Glu | Val | D-Cys | Cys | Thr | Pro | Ala | Cys | Thr | Gly | Cys | Tyr |
| Ala | Gly | Cys | Cys | Glu | Val | D-Cys | Cys | Thr | Pro | Ala | Cys | Thr | Gly | D-Cys | — |
| Ala | Gly | Cys | Cys | Glu | Val | D-Cys | Cys | Thr | Pro | Ala | Cys | Thr | Gly | D-Cys | Lys |
| Ala | Gly | Cys | Cys | Glu | Val | D-Cys | Cys | Thr | Pro | Ala | Cys | Thr | Gly | D-Cys | Tyr |
| Ala | Gly | Cys | Cys | Glu | Ile | Cys | Cys | Asn | Pro | Ala | Cys | Thr | Gly | Cys | — |
| Ala | Gly | Cys | Cys | Glu | Ile | Cys | Cys | Asn | Pro | Ala | Cys | Thr | Gly | Cys | Lys |
| Ala | Gly | Cys | Cys | Glu | Ile | Cys | Cys | Asn | Pro | Ala | Cys | Thr | Gly | Cys | Tyr |
| Ala | Gly | Cys | Cys | Glu | Ile | Cys | Cys | Asn | Pro | Ala | Cys | Thr | Gly | D-Cys | — |
| Ala | Gly | Cys | Cys | Glu | Ile | Cys | Cys | Asn | Pro | Ala | Cys | Thr | Gly | D-Cys | Lys |
| Ala | Gly | Cys | Cys | Glu | Ile | Cys | Cys | Asn | Pro | Ala | Cys | Thr | Gly | D-Cys | Tyr |
| Ala | Gly | Cys | Cys | Glu | Ile | Cys | Cys | Thr | Pro | Ala | Cys | Thr | Gly | Cys | — |
| Ala | Gly | Cys | Cys | Glu | Ile | Cys | Cys | Thr | Pro | Ala | Cys | Thr | Gly | Cys | Lys |
| Ala | Gly | Cys | Cys | Glu | Ile | Cys | Cys | Thr | Pro | Ala | Cys | Thr | Gly | Cys | Tyr |
| Ala | Gly | Cys | Cys | Glu | Ile | Cys | Cys | Thr | Pro | Ala | Cys | Thr | Gly | D-Cys | — |
| Ala | Gly | Cys | Cys | Glu | Ile | Cys | Cys | Thr | Pro | Ala | Cys | Thr | Gly | D-Cys | Lys |
| Ala | Gly | Cys | Cys | Glu | Ile | Cys | Cys | Thr | Pro | Ala | Cys | Thr | Gly | D-Cys | Tyr |
| Ala | Gly | Cys | Cys | Glu | Ile | D-Cys | Cys | Asn | Pro | Ala | Cys | Thr | Gly | Cys | — |
| Ala | Gly | Cys | Cys | Glu | Ile | D-Cys | Cys | Asn | Pro | Ala | Cys | Thr | Gly | Cys | Lys |
| Ala | Gly | Cys | Cys | Glu | Ile | D-Cys | Cys | Asn | Pro | Ala | Cys | Thr | Gly | Cys | Tyr |

FIG. 3A-39

| Ala | Gly | Cys | Cys | Glu | Ile | D-Cys | Cys | Asn | Pro | Ala | Cys | Thr | Gly | D-Cys | — |
|---|---|---|---|---|---|---|---|---|---|---|---|---|---|---|---|
| Ala | Gly | Cys | Cys | Glu | Ile | D-Cys | Cys | Asn | Pro | Ala | Cys | Thr | Gly | D-Cys | Lys |
| Ala | Gly | Cys | Cys | Glu | Ile | D-Cys | Cys | Asn | Pro | Ala | Cys | Thr | Gly | D-Cys | Tyr |
| Ala | Gly | Cys | Cys | Glu | Ile | D-Cys | Cys | Thr | Pro | Ala | Cys | Thr | Gly | Cys | — |
| Ala | Gly | Cys | Cys | Glu | Ile | D-Cys | Cys | Thr | Pro | Ala | Cys | Thr | Gly | Cys | Lys |
| Ala | Gly | Cys | Cys | Glu | Ile | D-Cys | Cys | Thr | Pro | Ala | Cys | Thr | Gly | Cys | Tyr |
| Ala | Gly | Cys | Cys | Glu | Ile | D-Cys | Cys | Thr | Pro | Ala | Cys | Thr | Gly | D-Cys | — |
| Ala | Gly | Cys | Cys | Glu | Ile | D-Cys | Cys | Thr | Pro | Ala | Cys | Thr | Gly | D-Cys | Lys |
| Ala | Gly | Cys | Cys | Glu | Ile | D-Cys | Cys | Thr | Pro | Ala | Cys | Thr | Gly | D-Cys | Tyr |
| Ala | Gly | Cys | Cys | Glu | Leu | Cys | Cys | Asn | Pro | Ala | Cys | Thr | Gly | Cys | — |
| Ala | Gly | Cys | Cys | Glu | Leu | Cys | Cys | Asn | Pro | Ala | Cys | Thr | Gly | Cys | Lys |
| Ala | Gly | Cys | Cys | Glu | Leu | Cys | Cys | Asn | Pro | Ala | Cys | Thr | Gly | Cys | Tyr |
| Ala | Gly | Cys | Cys | Glu | Leu | Cys | Cys | Asn | Pro | Ala | Cys | Thr | Gly | D-Cys | — |
| Ala | Gly | Cys | Cys | Glu | Leu | Cys | Cys | Asn | Pro | Ala | Cys | Thr | Gly | D-Cys | Lys |
| Ala | Gly | Cys | Cys | Glu | Leu | Cys | Cys | Asn | Pro | Ala | Cys | Thr | Gly | D-Cys | Tyr |
| Ala | Gly | Cys | Cys | Glu | Leu | Cys | Cys | Thr | Pro | Ala | Cys | Thr | Gly | Cys | — |
| Ala | Gly | Cys | Cys | Glu | Leu | Cys | Cys | Thr | Pro | Ala | Cys | Thr | Gly | Cys | Lys |
| Ala | Gly | Cys | Cys | Glu | Leu | Cys | Cys | Thr | Pro | Ala | Cys | Thr | Gly | Cys | Tyr |
| Ala | Gly | Cys | Cys | Glu | Leu | Cys | Cys | Thr | Pro | Ala | Cys | Thr | Gly | D-Cys | — |
| Ala | Gly | Cys | Cys | Glu | Leu | Cys | Cys | Thr | Pro | Ala | Cys | Thr | Gly | D-Cys | Lys |
| Ala | Gly | Cys | Cys | Glu | Leu | Cys | Cys | Thr | Pro | Ala | Cys | Thr | Gly | D-Cys | Tyr |
| Ala | Gly | Cys | Cys | Glu | Leu | D-Cys | Cys | Asn | Pro | Ala | Cys | Thr | Gly | Cys | — |
| Ala | Gly | Cys | Cys | Glu | Leu | D-Cys | Cys | Asn | Pro | Ala | Cys | Thr | Gly | Cys | Lys |
| Ala | Gly | Cys | Cys | Glu | Leu | D-Cys | Cys | Asn | Pro | Ala | Cys | Thr | Gly | Cys | Tyr |
| Ala | Gly | Cys | Cys | Glu | Leu | D-Cys | Cys | Asn | Pro | Ala | Cys | Thr | Gly | D-Cys | — |
| Ala | Gly | Cys | Cys | Glu | Leu | D-Cys | Cys | Asn | Pro | Ala | Cys | Thr | Gly | D-Cys | Lys |
| Ala | Gly | Cys | Cys | Glu | Leu | D-Cys | Cys | Asn | Pro | Ala | Cys | Thr | Gly | D-Cys | Tyr |
| Ala | Gly | Cys | Cys | Glu | Leu | D-Cys | Cys | Thr | Pro | Ala | Cys | Thr | Gly | Cys | — |
| Ala | Gly | Cys | Cys | Glu | Leu | D-Cys | Cys | Thr | Pro | Ala | Cys | Thr | Gly | Cys | Lys |
| Ala | Gly | Cys | Cys | Glu | Leu | D-Cys | Cys | Thr | Pro | Ala | Cys | Thr | Gly | Cys | Tyr |
| Ala | Gly | Cys | Cys | Glu | Leu | D-Cys | Cys | Thr | Pro | Ala | Cys | Thr | Gly | D-Cys | — |
| Ala | Gly | Cys | Cys | Glu | Leu | D-Cys | Cys | Thr | Pro | Ala | Cys | Thr | Gly | D-Cys | Lys |
| Ala | Gly | Cys | Cys | Glu | Leu | D-Cys | Cys | Thr | Pro | Ala | Cys | Thr | Gly | D-Cys | Tyr |
| Ala | Gly | Cys | Cys | Glu | Tyr | Cys | Cys | Asn | Pro | Ala | Cys | Thr | Gly | Cys | — |
| Ala | Gly | Cys | Cys | Glu | Tyr | Cys | Cys | Asn | Pro | Ala | Cys | Thr | Gly | Cys | Lys |
| Ala | Gly | Cys | Cys | Glu | Tyr | Cys | Cys | Asn | Pro | Ala | Cys | Thr | Gly | Cys | Tyr |
| Ala | Gly | Cys | Cys | Glu | Tyr | Cys | Cys | Asn | Pro | Ala | Cys | Thr | Gly | D-Cys | — |
| Ala | Gly | Cys | Cys | Glu | Tyr | Cys | Cys | Asn | Pro | Ala | Cys | Thr | Gly | D-Cys | Lys |
| Ala | Gly | Cys | Cys | Glu | Tyr | Cys | Cys | Asn | Pro | Ala | Cys | Thr | Gly | D-Cys | Tyr |
| Ala | Gly | Cys | Cys | Glu | Tyr | Cys | Cys | Thr | Pro | Ala | Cys | Thr | Gly | Cys | — |
| Ala | Gly | Cys | Cys | Glu | Tyr | Cys | Cys | Thr | Pro | Ala | Cys | Thr | Gly | Cys | Lys |
| Ala | Gly | Cys | Cys | Glu | Tyr | Cys | Cys | Thr | Pro | Ala | Cys | Thr | Gly | Cys | Tyr |
| Ala | Gly | Cys | Cys | Glu | Tyr | Cys | Cys | Thr | Pro | Ala | Cys | Thr | Gly | D-Cys | — |
| Ala | Gly | Cys | Cys | Glu | Tyr | Cys | Cys | Thr | Pro | Ala | Cys | Thr | Gly | D-Cys | Lys |
| Ala | Gly | Cys | Cys | Glu | Tyr | Cys | Cys | Thr | Pro | Ala | Cys | Thr | Gly | D-Cys | Tyr |
| Ala | Gly | Cys | Cys | Glu | Tyr | D-Cys | Cys | Asn | Pro | Ala | Cys | Thr | Gly | Cys | — |
| Ala | Gly | Cys | Cys | Glu | Tyr | D-Cys | Cys | Asn | Pro | Ala | Cys | Thr | Gly | Cys | Lys |
| Ala | Gly | Cys | Cys | Glu | Tyr | D-Cys | Cys | Asn | Pro | Ala | Cys | Thr | Gly | Cys | Tyr |
| Ala | Gly | Cys | Cys | Glu | Tyr | D-Cys | Cys | Asn | Pro | Ala | Cys | Thr | Gly | D-Cys | — |
| Ala | Gly | Cys | Cys | Glu | Tyr | D-Cys | Cys | Asn | Pro | Ala | Cys | Thr | Gly | D-Cys | Lys |
| Ala | Gly | Cys | Cys | Glu | Tyr | D-Cys | Cys | Asn | Pro | Ala | Cys | Thr | Gly | D-Cys | Tyr |
| Ala | Gly | Cys | Cys | Glu | Tyr | D-Cys | Cys | Thr | Pro | Ala | Cys | Thr | Gly | Cys | — |
| Ala | Gly | Cys | Cys | Glu | Tyr | D-Cys | Cys | Thr | Pro | Ala | Cys | Thr | Gly | Cys | Lys |
| Ala | Gly | Cys | Cys | Glu | Tyr | D-Cys | Cys | Thr | Pro | Ala | Cys | Thr | Gly | Cys | Tyr |
| Ala | Gly | Cys | Cys | Glu | Tyr | D-Cys | Cys | Thr | Pro | Ala | Cys | Thr | Gly | D-Cys | — |
| Ala | Gly | Cys | Cys | Glu | Tyr | D-Cys | Cys | Thr | Pro | Ala | Cys | Thr | Gly | D-Cys | Lys |
| Ala | Gly | Cys | Cys | Glu | Tyr | D-Cys | Cys | Thr | Pro | Ala | Cys | Thr | Gly | D-Cys | Tyr |
| Ala | Gly | Cys | Cys | Glu | Phe | Cys | Cys | Asn | Pro | Ala | Cys | Thr | Gly | Cys | — |
| Ala | Gly | Cys | Cys | Glu | Phe | Cys | Cys | Asn | Pro | Ala | Cys | Thr | Gly | Cys | Lys |
| Ala | Gly | Cys | Cys | Glu | Phe | Cys | Cys | Asn | Pro | Ala | Cys | Thr | Gly | Cys | Tyr |

FIG. 3A-40

| Ala | Gly | Cys | Cys | Glu | Phe | Cys | Cys | Asn | Pro | Ala | Cys | Thr | Gly | D-Cys | — |
|---|---|---|---|---|---|---|---|---|---|---|---|---|---|---|---|
| Ala | Gly | Cys | Cys | Glu | Phe | Cys | Cys | Asn | Pro | Ala | Cys | Thr | Gly | D-Cys | Lys |
| Ala | Gly | Cys | Cys | Glu | Phe | Cys | Cys | Asn | Pro | Ala | Cys | Thr | Gly | D-Cys | Tyr |
| Ala | Gly | Cys | Cys | Glu | Phe | Cys | Cys | Thr | Pro | Ala | Cys | Thr | Gly | Cys | — |
| Ala | Gly | Cys | Cys | Glu | Phe | Cys | Cys | Thr | Pro | Ala | Cys | Thr | Gly | Cys | Lys |
| Ala | Gly | Cys | Cys | Glu | Phe | Cys | Cys | Thr | Pro | Ala | Cys | Thr | Gly | Cys | Tyr |
| Ala | Gly | Cys | Cys | Glu | Phe | Cys | Cys | Thr | Pro | Ala | Cys | Thr | Gly | D-Cys | — |
| Ala | Gly | Cys | Cys | Glu | Phe | Cys | Cys | Thr | Pro | Ala | Cys | Thr | Gly | D-Cys | Lys |
| Ala | Gly | Cys | Cys | Glu | Phe | Cys | Cys | Thr | Pro | Ala | Cys | Thr | Gly | D-Cys | Tyr |
| Ala | Gly | Cys | Cys | Glu | Phe | D-Cys | Cys | Asn | Pro | Ala | Cys | Thr | Gly | Cys | — |
| Ala | Gly | Cys | Cys | Glu | Phe | D-Cys | Cys | Asn | Pro | Ala | Cys | Thr | Gly | Cys | Lys |
| Ala | Gly | Cys | Cys | Glu | Phe | D-Cys | Cys | Asn | Pro | Ala | Cys | Thr | Gly | Cys | Tyr |
| Ala | Gly | Cys | Cys | Glu | Phe | D-Cys | Cys | Asn | Pro | Ala | Cys | Thr | Gly | D-Cys | — |
| Ala | Gly | Cys | Cys | Glu | Phe | D-Cys | Cys | Asn | Pro | Ala | Cys | Thr | Gly | D-Cys | Lys |
| Ala | Gly | Cys | Cys | Glu | Phe | D-Cys | Cys | Asn | Pro | Ala | Cys | Thr | Gly | D-Cys | Tyr |
| Ala | Gly | Cys | Cys | Glu | Phe | D-Cys | Cys | Thr | Pro | Ala | Cys | Thr | Gly | Cys | — |
| Ala | Gly | Cys | Cys | Glu | Phe | D-Cys | Cys | Thr | Pro | Ala | Cys | Thr | Gly | Cys | Lys |
| Ala | Gly | Cys | Cys | Glu | Phe | D-Cys | Cys | Thr | Pro | Ala | Cys | Thr | Gly | Cys | Tyr |
| Ala | Gly | Cys | Cys | Glu | Phe | D-Cys | Cys | Thr | Pro | Ala | Cys | Thr | Gly | D-Cys | — |
| Ala | Gly | Cys | Cys | Glu | Phe | D-Cys | Cys | Thr | Pro | Ala | Cys | Thr | Gly | D-Cys | Lys |
| Ala | Gly | Cys | Cys | Glu | Phe | D-Cys | Cys | Thr | Pro | Ala | Cys | Thr | Gly | D-Cys | Tyr |
| Ala | Gly | Cys | Cys | Glu | Trp | Cys | Cys | Asn | Pro | Ala | Cys | Thr | Gly | Cys | — |
| Ala | Gly | Cys | Cys | Glu | Trp | Cys | Cys | Asn | Pro | Ala | Cys | Thr | Gly | Cys | Lys |
| Ala | Gly | Cys | Cys | Glu | Trp | Cys | Cys | Asn | Pro | Ala | Cys | Thr | Gly | Cys | Tyr |
| Ala | Gly | Cys | Cys | Glu | Trp | Cys | Cys | Asn | Pro | Ala | Cys | Thr | Gly | D-Cys | — |
| Ala | Gly | Cys | Cys | Glu | Trp | Cys | Cys | Asn | Pro | Ala | Cys | Thr | Gly | D-Cys | Lys |
| Ala | Gly | Cys | Cys | Glu | Trp | Cys | Cys | Asn | Pro | Ala | Cys | Thr | Gly | D-Cys | Tyr |
| Ala | Gly | Cys | Cys | Glu | Trp | Cys | Cys | Thr | Pro | Ala | Cys | Thr | Gly | Cys | — |
| Ala | Gly | Cys | Cys | Glu | Trp | Cys | Cys | Thr | Pro | Ala | Cys | Thr | Gly | Cys | Lys |
| Ala | Gly | Cys | Cys | Glu | Trp | Cys | Cys | Thr | Pro | Ala | Cys | Thr | Gly | Cys | Tyr |
| Ala | Gly | Cys | Cys | Glu | Trp | Cys | Cys | Thr | Pro | Ala | Cys | Thr | Gly | D-Cys | — |
| Ala | Gly | Cys | Cys | Glu | Trp | Cys | Cys | Thr | Pro | Ala | Cys | Thr | Gly | D-Cys | Lys |
| Ala | Gly | Cys | Cys | Glu | Trp | Cys | Cys | Thr | Pro | Ala | Cys | Thr | Gly | D-Cys | Tyr |
| Ala | Gly | Cys | Cys | Glu | Trp | D-Cys | Cys | Asn | Pro | Ala | Cys | Thr | Gly | Cys | — |
| Ala | Gly | Cys | Cys | Glu | Trp | D-Cys | Cys | Asn | Pro | Ala | Cys | Thr | Gly | Cys | Lys |
| Ala | Gly | Cys | Cys | Glu | Trp | D-Cys | Cys | Asn | Pro | Ala | Cys | Thr | Gly | Cys | Tyr |
| Ala | Gly | Cys | Cys | Glu | Trp | D-Cys | Cys | Asn | Pro | Ala | Cys | Thr | Gly | D-Cys | — |
| Ala | Gly | Cys | Cys | Glu | Trp | D-Cys | Cys | Asn | Pro | Ala | Cys | Thr | Gly | D-Cys | Lys |
| Ala | Gly | Cys | Cys | Glu | Trp | D-Cys | Cys | Asn | Pro | Ala | Cys | Thr | Gly | D-Cys | Tyr |
| Ala | Gly | Cys | Cys | Glu | Trp | D-Cys | Cys | Thr | Pro | Ala | Cys | Thr | Gly | Cys | — |
| Ala | Gly | Cys | Cys | Glu | Trp | D-Cys | Cys | Thr | Pro | Ala | Cys | Thr | Gly | Cys | Lys |
| Ala | Gly | Cys | Cys | Glu | Trp | D-Cys | Cys | Thr | Pro | Ala | Cys | Thr | Gly | Cys | Tyr |
| Ala | Gly | Cys | Cys | Glu | Trp | D-Cys | Cys | Thr | Pro | Ala | Cys | Thr | Gly | D-Cys | — |
| Ala | Gly | Cys | Cys | Glu | Trp | D-Cys | Cys | Thr | Pro | Ala | Cys | Thr | Gly | D-Cys | Lys |
| Ala | Gly | Cys | Cys | Glu | Trp | D-Cys | Cys | Thr | Pro | Ala | Cys | Thr | Gly | D-Cys | Tyr |
| Ala | Gly | D-Cys | Cys | Glu | Val | Cys | Cys | Asn | Pro | Ala | Cys | Thr | Gly | Cys | — |
| Ala | Gly | D-Cys | Cys | Glu | Val | Cys | Cys | Asn | Pro | Ala | Cys | Thr | Gly | Cys | Lys |
| Ala | Gly | D-Cys | Cys | Glu | Val | Cys | Cys | Asn | Pro | Ala | Cys | Thr | Gly | Cys | Tyr |
| Ala | Gly | D-Cys | Cys | Glu | Val | Cys | Cys | Asn | Pro | Ala | Cys | Thr | Gly | D-Cys | — |
| Ala | Gly | D-Cys | Cys | Glu | Val | Cys | Cys | Asn | Pro | Ala | Cys | Thr | Gly | D-Cys | Lys |
| Ala | Gly | D-Cys | Cys | Glu | Val | Cys | Cys | Asn | Pro | Ala | Cys | Thr | Gly | D-Cys | Tyr |
| Ala | Gly | D-Cys | Cys | Glu | Val | Cys | Cys | Thr | Pro | Ala | Cys | Thr | Gly | Cys | — |
| Ala | Gly | D-Cys | Cys | Glu | Val | Cys | Cys | Thr | Pro | Ala | Cys | Thr | Gly | Cys | Lys |
| Ala | Gly | D-Cys | Cys | Glu | Val | Cys | Cys | Thr | Pro | Ala | Cys | Thr | Gly | Cys | Tyr |
| Ala | Gly | D-Cys | Cys | Glu | Val | Cys | Cys | Thr | Pro | Ala | Cys | Thr | Gly | D-Cys | — |
| Ala | Gly | D-Cys | Cys | Glu | Val | Cys | Cys | Thr | Pro | Ala | Cys | Thr | Gly | D-Cys | Lys |
| Ala | Gly | D-Cys | Cys | Glu | Val | Cys | Cys | Thr | Pro | Ala | Cys | Thr | Gly | D-Cys | Tyr |
| Ala | Gly | D-Cys | Cys | Glu | Val | D-Cys | Cys | Asn | Pro | Ala | Cys | Thr | Gly | Cys | — |
| Ala | Gly | D-Cys | Cys | Glu | Val | D-Cys | Cys | Asn | Pro | Ala | Cys | Thr | Gly | Cys | Lys |
| Ala | Gly | D-Cys | Cys | Glu | Val | D-Cys | Cys | Asn | Pro | Ala | Cys | Thr | Gly | Cys | Tyr |

FIG. 3A-41

| Ala | Gly | D-Cys | Cys | Glu | Val | D-Cys | Cys | Asn | Pro | Ala | Cys | Thr | Gly | D-Cys | — |
| Ala | Gly | D-Cys | Cys | Glu | Val | D-Cys | Cys | Asn | Pro | Ala | Cys | Thr | Gly | D-Cys | Lys |
| Ala | Gly | D-Cys | Cys | Glu | Val | D-Cys | Cys | Asn | Pro | Ala | Cys | Thr | Gly | D-Cys | Tyr |
| Ala | Gly | D-Cys | Cys | Glu | Val | D-Cys | Cys | Thr | Pro | Ala | Cys | Thr | Gly | Cys | — |
| Ala | Gly | D-Cys | Cys | Glu | Val | D-Cys | Cys | Thr | Pro | Ala | Cys | Thr | Gly | Cys | Lys |
| Ala | Gly | D-Cys | Cys | Glu | Val | D-Cys | Cys | Thr | Pro | Ala | Cys | Thr | Gly | Cys | Tyr |
| Ala | Gly | D-Cys | Cys | Glu | Val | D-Cys | Cys | Thr | Pro | Ala | Cys | Thr | Gly | D-Cys | — |
| Ala | Gly | D-Cys | Cys | Glu | Val | D-Cys | Cys | Thr | Pro | Ala | Cys | Thr | Gly | D-Cys | Lys |
| Ala | Gly | D-Cys | Cys | Glu | Val | D-Cys | Cys | Thr | Pro | Ala | Cys | Thr | Gly | D-Cys | Tyr |
| Ala | Gly | D-Cys | Cys | Glu | Ile | Cys | Cys | Asn | Pro | Ala | Cys | Thr | Gly | Cys | — |
| Ala | Gly | D-Cys | Cys | Glu | Ile | Cys | Cys | Asn | Pro | Ala | Cys | Thr | Gly | Cys | Lys |
| Ala | Gly | D-Cys | Cys | Glu | Ile | Cys | Cys | Asn | Pro | Ala | Cys | Thr | Gly | Cys | Tyr |
| Ala | Gly | D-Cys | Cys | Glu | Ile | Cys | Cys | Asn | Pro | Ala | Cys | Thr | Gly | D-Cys | — |
| Ala | Gly | D-Cys | Cys | Glu | Ile | Cys | Cys | Asn | Pro | Ala | Cys | Thr | Gly | D-Cys | Lys |
| Ala | Gly | D-Cys | Cys | Glu | Ile | Cys | Cys | Asn | Pro | Ala | Cys | Thr | Gly | D-Cys | Tyr |
| Ala | Gly | D-Cys | Cys | Glu | Ile | Cys | Cys | Thr | Pro | Ala | Cys | Thr | Gly | Cys | — |
| Ala | Gly | D-Cys | Cys | Glu | Ile | Cys | Cys | Thr | Pro | Ala | Cys | Thr | Gly | Cys | Lys |
| Ala | Gly | D-Cys | Cys | Glu | Ile | Cys | Cys | Thr | Pro | Ala | Cys | Thr | Gly | Cys | Tyr |
| Ala | Gly | D-Cys | Cys | Glu | Ile | Cys | Cys | Thr | Pro | Ala | Cys | Thr | Gly | D-Cys | — |
| Ala | Gly | D-Cys | Cys | Glu | Ile | Cys | Cys | Thr | Pro | Ala | Cys | Thr | Gly | D-Cys | Lys |
| Ala | Gly | D-Cys | Cys | Glu | Ile | Cys | Cys | Thr | Pro | Ala | Cys | Thr | Gly | D-Cys | Tyr |
| Ala | Gly | D-Cys | Cys | Glu | Ile | D-Cys | Cys | Asn | Pro | Ala | Cys | Thr | Gly | Cys | — |
| Ala | Gly | D-Cys | Cys | Glu | Ile | D-Cys | Cys | Asn | Pro | Ala | Cys | Thr | Gly | Cys | Lys |
| Ala | Gly | D-Cys | Cys | Glu | Ile | D-Cys | Cys | Asn | Pro | Ala | Cys | Thr | Gly | Cys | Tyr |
| Ala | Gly | D-Cys | Cys | Glu | Ile | D-Cys | Cys | Asn | Pro | Ala | Cys | Thr | Gly | D-Cys | — |
| Ala | Gly | D-Cys | Cys | Glu | Ile | D-Cys | Cys | Asn | Pro | Ala | Cys | Thr | Gly | D-Cys | Lys |
| Ala | Gly | D-Cys | Cys | Glu | Ile | D-Cys | Cys | Asn | Pro | Ala | Cys | Thr | Gly | D-Cys | Tyr |
| Ala | Gly | D-Cys | Cys | Glu | Ile | D-Cys | Cys | Thr | Pro | Ala | Cys | Thr | Gly | Cys | — |
| Ala | Gly | D-Cys | Cys | Glu | Ile | D-Cys | Cys | Thr | Pro | Ala | Cys | Thr | Gly | Cys | Lys |
| Ala | Gly | D-Cys | Cys | Glu | Ile | D-Cys | Cys | Thr | Pro | Ala | Cys | Thr | Gly | Cys | Tyr |
| Ala | Gly | D-Cys | Cys | Glu | Ile | D-Cys | Cys | Thr | Pro | Ala | Cys | Thr | Gly | D-Cys | — |
| Ala | Gly | D-Cys | Cys | Glu | Ile | D-Cys | Cys | Thr | Pro | Ala | Cys | Thr | Gly | D-Cys | Lys |
| Ala | Gly | D-Cys | Cys | Glu | Ile | D-Cys | Cys | Thr | Pro | Ala | Cys | Thr | Gly | D-Cys | Tyr |
| Ala | Gly | D-Cys | Cys | Glu | Leu | Cys | Cys | Asn | Pro | Ala | Cys | Thr | Gly | Cys | — |
| Ala | Gly | D-Cys | Cys | Glu | Leu | Cys | Cys | Asn | Pro | Ala | Cys | Thr | Gly | Cys | Lys |
| Ala | Gly | D-Cys | Cys | Glu | Leu | Cys | Cys | Asn | Pro | Ala | Cys | Thr | Gly | Cys | Tyr |
| Ala | Gly | D-Cys | Cys | Glu | Leu | Cys | Cys | Asn | Pro | Ala | Cys | Thr | Gly | D-Cys | — |
| Ala | Gly | D-Cys | Cys | Glu | Leu | Cys | Cys | Asn | Pro | Ala | Cys | Thr | Gly | D-Cys | Lys |
| Ala | Gly | D-Cys | Cys | Glu | Leu | Cys | Cys | Asn | Pro | Ala | Cys | Thr | Gly | D-Cys | Tyr |
| Ala | Gly | D-Cys | Cys | Glu | Leu | Cys | Cys | Thr | Pro | Ala | Cys | Thr | Gly | Cys | — |
| Ala | Gly | D-Cys | Cys | Glu | Leu | Cys | Cys | Thr | Pro | Ala | Cys | Thr | Gly | Cys | Lys |
| Ala | Gly | D-Cys | Cys | Glu | Leu | Cys | Cys | Thr | Pro | Ala | Cys | Thr | Gly | Cys | Tyr |
| Ala | Gly | D-Cys | Cys | Glu | Leu | Cys | Cys | Thr | Pro | Ala | Cys | Thr | Gly | D-Cys | — |
| Ala | Gly | D-Cys | Cys | Glu | Leu | Cys | Cys | Thr | Pro | Ala | Cys | Thr | Gly | D-Cys | Lys |
| Ala | Gly | D-Cys | Cys | Glu | Leu | Cys | Cys | Thr | Pro | Ala | Cys | Thr | Gly | D-Cys | Tyr |
| Ala | Gly | D-Cys | Cys | Glu | Leu | D-Cys | Cys | Asn | Pro | Ala | Cys | Thr | Gly | Cys | — |
| Ala | Gly | D-Cys | Cys | Glu | Leu | D-Cys | Cys | Asn | Pro | Ala | Cys | Thr | Gly | Cys | Lys |
| Ala | Gly | D-Cys | Cys | Glu | Leu | D-Cys | Cys | Asn | Pro | Ala | Cys | Thr | Gly | Cys | Tyr |
| Ala | Gly | D-Cys | Cys | Glu | Leu | D-Cys | Cys | Asn | Pro | Ala | Cys | Thr | Gly | D-Cys | — |
| Ala | Gly | D-Cys | Cys | Glu | Leu | D-Cys | Cys | Asn | Pro | Ala | Cys | Thr | Gly | D-Cys | Lys |
| Ala | Gly | D-Cys | Cys | Glu | Leu | D-Cys | Cys | Asn | Pro | Ala | Cys | Thr | Gly | D-Cys | Tyr |
| Ala | Gly | D-Cys | Cys | Glu | Leu | D-Cys | Cys | Thr | Pro | Ala | Cys | Thr | Gly | Cys | — |
| Ala | Gly | D-Cys | Cys | Glu | Leu | D-Cys | Cys | Thr | Pro | Ala | Cys | Thr | Gly | Cys | Lys |
| Ala | Gly | D-Cys | Cys | Glu | Leu | D-Cys | Cys | Thr | Pro | Ala | Cys | Thr | Gly | Cys | Tyr |
| Ala | Gly | D-Cys | Cys | Glu | Leu | D-Cys | Cys | Thr | Pro | Ala | Cys | Thr | Gly | D-Cys | — |
| Ala | Gly | D-Cys | Cys | Glu | Leu | D-Cys | Cys | Thr | Pro | Ala | Cys | Thr | Gly | D-Cys | Lys |
| Ala | Gly | D-Cys | Cys | Glu | Leu | D-Cys | Cys | Thr | Pro | Ala | Cys | Thr | Gly | D-Cys | Tyr |
| Ala | Gly | D-Cys | Cys | Glu | Tyr | Cys | Cys | Asn | Pro | Ala | Cys | Thr | Gly | Cys | — |
| Ala | Gly | D-Cys | Cys | Glu | Tyr | Cys | Cys | Asn | Pro | Ala | Cys | Thr | Gly | Cys | Lys |
| Ala | Gly | D-Cys | Cys | Glu | Tyr | Cys | Cys | Asn | Pro | Ala | Cys | Thr | Gly | Cys | Tyr |

FIG. 3A-42

| Ala | Gly | D-Cys | Cys | Glu | Tyr | Cys | Cys | Asn | Pro | Ala | Cys | Thr | Gly | D-Cys | — |
|---|---|---|---|---|---|---|---|---|---|---|---|---|---|---|---|
| Ala | Gly | D-Cys | Cys | Glu | Tyr | Cys | Cys | Asn | Pro | Ala | Cys | Thr | Gly | D-Cys | Lys |
| Ala | Gly | D-Cys | Cys | Glu | Tyr | Cys | Cys | Asn | Pro | Ala | Cys | Thr | Gly | D-Cys | Tyr |
| Ala | Gly | D-Cys | Cys | Glu | Tyr | Cys | Cys | Thr | Pro | Ala | Cys | Thr | Gly | Cys | — |
| Ala | Gly | D-Cys | Cys | Glu | Tyr | Cys | Cys | Thr | Pro | Ala | Cys | Thr | Gly | Cys | Lys |
| Ala | Gly | D-Cys | Cys | Glu | Tyr | Cys | Cys | Thr | Pro | Ala | Cys | Thr | Gly | Cys | Tyr |
| Ala | Gly | D-Cys | Cys | Glu | Tyr | Cys | Cys | Thr | Pro | Ala | Cys | Thr | Gly | D-Cys | — |
| Ala | Gly | D-Cys | Cys | Glu | Tyr | Cys | Cys | Thr | Pro | Ala | Cys | Thr | Gly | D-Cys | Lys |
| Ala | Gly | D-Cys | Cys | Glu | Tyr | Cys | Cys | Thr | Pro | Ala | Cys | Thr | Gly | D-Cys | Tyr |
| Ala | Gly | D-Cys | Cys | Glu | Tyr | D-Cys | Cys | Asn | Pro | Ala | Cys | Thr | Gly | Cys | — |
| Ala | Gly | D-Cys | Cys | Glu | Tyr | D-Cys | Cys | Asn | Pro | Ala | Cys | Thr | Gly | Cys | Lys |
| Ala | Gly | D-Cys | Cys | Glu | Tyr | D-Cys | Cys | Asn | Pro | Ala | Cys | Thr | Gly | Cys | Tyr |
| Ala | Gly | D-Cys | Cys | Glu | Tyr | D-Cys | Cys | Asn | Pro | Ala | Cys | Thr | Gly | D-Cys | — |
| Ala | Gly | D-Cys | Cys | Glu | Tyr | D-Cys | Cys | Asn | Pro | Ala | Cys | Thr | Gly | D-Cys | Lys |
| Ala | Gly | D-Cys | Cys | Glu | Tyr | D-Cys | Cys | Asn | Pro | Ala | Cys | Thr | Gly | D-Cys | Tyr |
| Ala | Gly | D-Cys | Cys | Glu | Tyr | D-Cys | Cys | Thr | Pro | Ala | Cys | Thr | Gly | Cys | — |
| Ala | Gly | D-Cys | Cys | Glu | Tyr | D-Cys | Cys | Thr | Pro | Ala | Cys | Thr | Gly | Cys | Lys |
| Ala | Gly | D-Cys | Cys | Glu | Tyr | D-Cys | Cys | Thr | Pro | Ala | Cys | Thr | Gly | Cys | Tyr |
| Ala | Gly | D-Cys | Cys | Glu | Tyr | D-Cys | Cys | Thr | Pro | Ala | Cys | Thr | Gly | D-Cys | — |
| Ala | Gly | D-Cys | Cys | Glu | Tyr | D-Cys | Cys | Thr | Pro | Ala | Cys | Thr | Gly | D-Cys | Lys |
| Ala | Gly | D-Cys | Cys | Glu | Tyr | D-Cys | Cys | Thr | Pro | Ala | Cys | Thr | Gly | D-Cys | Tyr |
| Ala | Gly | D-Cys | Cys | Glu | Phe | Cys | Cys | Asn | Pro | Ala | Cys | Thr | Gly | Cys | — |
| Ala | Gly | D-Cys | Cys | Glu | Phe | Cys | Cys | Asn | Pro | Ala | Cys | Thr | Gly | Cys | Lys |
| Ala | Gly | D-Cys | Cys | Glu | Phe | Cys | Cys | Asn | Pro | Ala | Cys | Thr | Gly | Cys | Tyr |
| Ala | Gly | D-Cys | Cys | Glu | Phe | Cys | Cys | Asn | Pro | Ala | Cys | Thr | Gly | D-Cys | — |
| Ala | Gly | D-Cys | Cys | Glu | Phe | Cys | Cys | Asn | Pro | Ala | Cys | Thr | Gly | D-Cys | Lys |
| Ala | Gly | D-Cys | Cys | Glu | Phe | Cys | Cys | Asn | Pro | Ala | Cys | Thr | Gly | D-Cys | Tyr |
| Ala | Gly | D-Cys | Cys | Glu | Phe | Cys | Cys | Thr | Pro | Ala | Cys | Thr | Gly | Cys | — |
| Ala | Gly | D-Cys | Cys | Glu | Phe | Cys | Cys | Thr | Pro | Ala | Cys | Thr | Gly | Cys | Lys |
| Ala | Gly | D-Cys | Cys | Glu | Phe | Cys | Cys | Thr | Pro | Ala | Cys | Thr | Gly | Cys | Tyr |
| Ala | Gly | D-Cys | Cys | Glu | Phe | Cys | Cys | Thr | Pro | Ala | Cys | Thr | Gly | D-Cys | — |
| Ala | Gly | D-Cys | Cys | Glu | Phe | Cys | Cys | Thr | Pro | Ala | Cys | Thr | Gly | D-Cys | Lys |
| Ala | Gly | D-Cys | Cys | Glu | Phe | Cys | Cys | Thr | Pro | Ala | Cys | Thr | Gly | D-Cys | Tyr |
| Ala | Gly | D-Cys | Cys | Glu | Phe | D-Cys | Cys | Asn | Pro | Ala | Cys | Thr | Gly | Cys | — |
| Ala | Gly | D-Cys | Cys | Glu | Phe | D-Cys | Cys | Asn | Pro | Ala | Cys | Thr | Gly | Cys | Lys |
| Ala | Gly | D-Cys | Cys | Glu | Phe | D-Cys | Cys | Asn | Pro | Ala | Cys | Thr | Gly | Cys | Tyr |
| Ala | Gly | D-Cys | Cys | Glu | Phe | D-Cys | Cys | Asn | Pro | Ala | Cys | Thr | Gly | D-Cys | — |
| Ala | Gly | D-Cys | Cys | Glu | Phe | D-Cys | Cys | Asn | Pro | Ala | Cys | Thr | Gly | D-Cys | Lys |
| Ala | Gly | D-Cys | Cys | Glu | Phe | D-Cys | Cys | Asn | Pro | Ala | Cys | Thr | Gly | D-Cys | Tyr |
| Ala | Gly | D-Cys | Cys | Glu | Phe | D-Cys | Cys | Thr | Pro | Ala | Cys | Thr | Gly | Cys | — |
| Ala | Gly | D-Cys | Cys | Glu | Phe | D-Cys | Cys | Thr | Pro | Ala | Cys | Thr | Gly | Cys | Lys |
| Ala | Gly | D-Cys | Cys | Glu | Phe | D-Cys | Cys | Thr | Pro | Ala | Cys | Thr | Gly | Cys | Tyr |
| Ala | Gly | D-Cys | Cys | Glu | Phe | D-Cys | Cys | Thr | Pro | Ala | Cys | Thr | Gly | D-Cys | — |
| Ala | Gly | D-Cys | Cys | Glu | Phe | D-Cys | Cys | Thr | Pro | Ala | Cys | Thr | Gly | D-Cys | Lys |
| Ala | Gly | D-Cys | Cys | Glu | Phe | D-Cys | Cys | Thr | Pro | Ala | Cys | Thr | Gly | D-Cys | Tyr |
| Ala | Gly | D-Cys | Cys | Glu | Trp | Cys | Cys | Asn | Pro | Ala | Cys | Thr | Gly | Cys | — |
| Ala | Gly | D-Cys | Cys | Glu | Trp | Cys | Cys | Asn | Pro | Ala | Cys | Thr | Gly | Cys | Lys |
| Ala | Gly | D-Cys | Cys | Glu | Trp | Cys | Cys | Asn | Pro | Ala | Cys | Thr | Gly | Cys | Tyr |
| Ala | Gly | D-Cys | Cys | Glu | Trp | Cys | Cys | Asn | Pro | Ala | Cys | Thr | Gly | D-Cys | — |
| Ala | Gly | D-Cys | Cys | Glu | Trp | Cys | Cys | Asn | Pro | Ala | Cys | Thr | Gly | D-Cys | Lys |
| Ala | Gly | D-Cys | Cys | Glu | Trp | Cys | Cys | Asn | Pro | Ala | Cys | Thr | Gly | D-Cys | Tyr |
| Ala | Gly | D-Cys | Cys | Glu | Trp | Cys | Cys | Thr | Pro | Ala | Cys | Thr | Gly | Cys | — |
| Ala | Gly | D-Cys | Cys | Glu | Trp | Cys | Cys | Thr | Pro | Ala | Cys | Thr | Gly | Cys | Lys |
| Ala | Gly | D-Cys | Cys | Glu | Trp | Cys | Cys | Thr | Pro | Ala | Cys | Thr | Gly | Cys | Tyr |
| Ala | Gly | D-Cys | Cys | Glu | Trp | Cys | Cys | Thr | Pro | Ala | Cys | Thr | Gly | D-Cys | — |
| Ala | Gly | D-Cys | Cys | Glu | Trp | Cys | Cys | Thr | Pro | Ala | Cys | Thr | Gly | D-Cys | Lys |
| Ala | Gly | D-Cys | Cys | Glu | Trp | Cys | Cys | Thr | Pro | Ala | Cys | Thr | Gly | D-Cys | Tyr |
| Ala | Gly | D-Cys | Cys | Glu | Trp | D-Cys | Cys | Asn | Pro | Ala | Cys | Thr | Gly | Cys | — |
| Ala | Gly | D-Cys | Cys | Glu | Trp | D-Cys | Cys | Asn | Pro | Ala | Cys | Thr | Gly | Cys | Lys |
| Ala | Gly | D-Cys | Cys | Glu | Trp | D-Cys | Cys | Asn | Pro | Ala | Cys | Thr | Gly | Cys | Tyr |

FIG. 3A-43

| Ala | Gly | D-Cys | Cys | Glu | Trp | D-Cys | Cys | Asn | Pro | Ala | Cys | Thr | Gly | D-Cys | — |
| Ala | Gly | D-Cys | Cys | Glu | Trp | D-Cys | Cys | Asn | Pro | Ala | Cys | Thr | Gly | D-Cys | Lys |
| Ala | Gly | D-Cys | Cys | Glu | Trp | D-Cys | Cys | Asn | Pro | Ala | Cys | Thr | Gly | D-Cys | Tyr |
| Ala | Gly | D-Cys | Cys | Glu | Trp | D-Cys | Cys | Thr | Pro | Ala | Cys | Thr | Gly | Cys | — |
| Ala | Gly | D-Cys | Cys | Glu | Trp | D-Cys | Cys | Thr | Pro | Ala | Cys | Thr | Gly | Cys | Lys |
| Ala | Gly | D-Cys | Cys | Glu | Trp | D-Cys | Cys | Thr | Pro | Ala | Cys | Thr | Gly | Cys | Tyr |
| Ala | Gly | D-Cys | Cys | Glu | Trp | D-Cys | Cys | Thr | Pro | Ala | Cys | Thr | Gly | D-Cys | — |
| Ala | Gly | D-Cys | Cys | Glu | Trp | D-Cys | Cys | Thr | Pro | Ala | Cys | Thr | Gly | D-Cys | Lys |
| Ala | Gly | D-Cys | Cys | Glu | Trp | D-Cys | Cys | Thr | Pro | Ala | Cys | Thr | Gly | D-Cys | Tyr |
| Ala | Lys | Cys | Cys | Glu | Val | Cys | Cys | Asn | Pro | Ala | Cys | Thr | Gly | Cys | — |
| Ala | Lys | Cys | Cys | Glu | Val | Cys | Cys | Asn | Pro | Ala | Cys | Thr | Gly | Cys | Lys |
| Ala | Lys | Cys | Cys | Glu | Val | Cys | Cys | Asn | Pro | Ala | Cys | Thr | Gly | Cys | Tyr |
| Ala | Lys | Cys | Cys | Glu | Val | Cys | Cys | Asn | Pro | Ala | Cys | Thr | Gly | D-Cys | — |
| Ala | Lys | Cys | Cys | Glu | Val | Cys | Cys | Asn | Pro | Ala | Cys | Thr | Gly | D-Cys | Lys |
| Ala | Lys | Cys | Cys | Glu | Val | Cys | Cys | Asn | Pro | Ala | Cys | Thr | Gly | D-Cys | Tyr |
| Ala | Lys | Cys | Cys | Glu | Val | Cys | Cys | Thr | Pro | Ala | Cys | Thr | Gly | Cys | — |
| Ala | Lys | Cys | Cys | Glu | Val | Cys | Cys | Thr | Pro | Ala | Cys | Thr | Gly | Cys | Lys |
| Ala | Lys | Cys | Cys | Glu | Val | Cys | Cys | Thr | Pro | Ala | Cys | Thr | Gly | Cys | Tyr |
| Ala | Lys | Cys | Cys | Glu | Val | Cys | Cys | Thr | Pro | Ala | Cys | Thr | Gly | D-Cys | — |
| Ala | Lys | Cys | Cys | Glu | Val | Cys | Cys | Thr | Pro | Ala | Cys | Thr | Gly | D-Cys | Lys |
| Ala | Lys | Cys | Cys | Glu | Val | Cys | Cys | Thr | Pro | Ala | Cys | Thr | Gly | D-Cys | Tyr |
| Ala | Lys | Cys | Cys | Glu | Val | D-Cys | Cys | Asn | Pro | Ala | Cys | Thr | Gly | Cys | — |
| Ala | Lys | Cys | Cys | Glu | Val | D-Cys | Cys | Asn | Pro | Ala | Cys | Thr | Gly | Cys | Lys |
| Ala | Lys | Cys | Cys | Glu | Val | D-Cys | Cys | Asn | Pro | Ala | Cys | Thr | Gly | Cys | Tyr |
| Ala | Lys | Cys | Cys | Glu | Val | D-Cys | Cys | Asn | Pro | Ala | Cys | Thr | Gly | D-Cys | — |
| Ala | Lys | Cys | Cys | Glu | Val | D-Cys | Cys | Asn | Pro | Ala | Cys | Thr | Gly | D-Cys | Lys |
| Ala | Lys | Cys | Cys | Glu | Val | D-Cys | Cys | Asn | Pro | Ala | Cys | Thr | Gly | D-Cys | Tyr |
| Ala | Lys | Cys | Cys | Glu | Val | D-Cys | Cys | Thr | Pro | Ala | Cys | Thr | Gly | Cys | — |
| Ala | Lys | Cys | Cys | Glu | Val | D-Cys | Cys | Thr | Pro | Ala | Cys | Thr | Gly | Cys | Lys |
| Ala | Lys | Cys | Cys | Glu | Val | D-Cys | Cys | Thr | Pro | Ala | Cys | Thr | Gly | Cys | Tyr |
| Ala | Lys | Cys | Cys | Glu | Val | D-Cys | Cys | Thr | Pro | Ala | Cys | Thr | Gly | D-Cys | — |
| Ala | Lys | Cys | Cys | Glu | Val | D-Cys | Cys | Thr | Pro | Ala | Cys | Thr | Gly | D-Cys | Lys |
| Ala | Lys | Cys | Cys | Glu | Val | D-Cys | Cys | Thr | Pro | Ala | Cys | Thr | Gly | D-Cys | Tyr |
| Ala | Lys | Cys | Cys | Glu | Ile | Cys | Cys | Asn | Pro | Ala | Cys | Thr | Gly | Cys | — |
| Ala | Lys | Cys | Cys | Glu | Ile | Cys | Cys | Asn | Pro | Ala | Cys | Thr | Gly | Cys | Lys |
| Ala | Lys | Cys | Cys | Glu | Ile | Cys | Cys | Asn | Pro | Ala | Cys | Thr | Gly | Cys | Tyr |
| Ala | Lys | Cys | Cys | Glu | Ile | Cys | Cys | Asn | Pro | Ala | Cys | Thr | Gly | D-Cys | — |
| Ala | Lys | Cys | Cys | Glu | Ile | Cys | Cys | Asn | Pro | Ala | Cys | Thr | Gly | D-Cys | Lys |
| Ala | Lys | Cys | Cys | Glu | Ile | Cys | Cys | Asn | Pro | Ala | Cys | Thr | Gly | D-Cys | Tyr |
| Ala | Lys | Cys | Cys | Glu | Ile | Cys | Cys | Thr | Pro | Ala | Cys | Thr | Gly | Cys | — |
| Ala | Lys | Cys | Cys | Glu | Ile | Cys | Cys | Thr | Pro | Ala | Cys | Thr | Gly | Cys | Lys |
| Ala | Lys | Cys | Cys | Glu | Ile | Cys | Cys | Thr | Pro | Ala | Cys | Thr | Gly | Cys | Tyr |
| Ala | Lys | Cys | Cys | Glu | Ile | Cys | Cys | Thr | Pro | Ala | Cys | Thr | Gly | D-Cys | — |
| Ala | Lys | Cys | Cys | Glu | Ile | Cys | Cys | Thr | Pro | Ala | Cys | Thr | Gly | D-Cys | Lys |
| Ala | Lys | Cys | Cys | Glu | Ile | Cys | Cys | Thr | Pro | Ala | Cys | Thr | Gly | D-Cys | Tyr |
| Ala | Lys | Cys | Cys | Glu | Ile | D-Cys | Cys | Asn | Pro | Ala | Cys | Thr | Gly | Cys | — |
| Ala | Lys | Cys | Cys | Glu | Ile | D-Cys | Cys | Asn | Pro | Ala | Cys | Thr | Gly | Cys | Lys |
| Ala | Lys | Cys | Cys | Glu | Ile | D-Cys | Cys | Asn | Pro | Ala | Cys | Thr | Gly | Cys | Tyr |
| Ala | Lys | Cys | Cys | Glu | Ile | D-Cys | Cys | Asn | Pro | Ala | Cys | Thr | Gly | D-Cys | — |
| Ala | Lys | Cys | Cys | Glu | Ile | D-Cys | Cys | Asn | Pro | Ala | Cys | Thr | Gly | D-Cys | Lys |
| Ala | Lys | Cys | Cys | Glu | Ile | D-Cys | Cys | Asn | Pro | Ala | Cys | Thr | Gly | D-Cys | Tyr |
| Ala | Lys | Cys | Cys | Glu | Ile | D-Cys | Cys | Thr | Pro | Ala | Cys | Thr | Gly | Cys | — |
| Ala | Lys | Cys | Cys | Glu | Ile | D-Cys | Cys | Thr | Pro | Ala | Cys | Thr | Gly | Cys | Lys |
| Ala | Lys | Cys | Cys | Glu | Ile | D-Cys | Cys | Thr | Pro | Ala | Cys | Thr | Gly | Cys | Tyr |
| Ala | Lys | Cys | Cys | Glu | Ile | D-Cys | Cys | Thr | Pro | Ala | Cys | Thr | Gly | D-Cys | — |
| Ala | Lys | Cys | Cys | Glu | Ile | D-Cys | Cys | Thr | Pro | Ala | Cys | Thr | Gly | D-Cys | Lys |
| Ala | Lys | Cys | Cys | Glu | Ile | D-Cys | Cys | Thr | Pro | Ala | Cys | Thr | Gly | D-Cys | Tyr |
| Ala | Lys | Cys | Cys | Glu | Leu | Cys | Cys | Asn | Pro | Ala | Cys | Thr | Gly | Cys | — |
| Ala | Lys | Cys | Cys | Glu | Leu | Cys | Cys | Asn | Pro | Ala | Cys | Thr | Gly | Cys | Lys |
| Ala | Lys | Cys | Cys | Glu | Leu | Cys | Cys | Asn | Pro | Ala | Cys | Thr | Gly | Cys | Tyr |

FIG. 3A-44

| | | | | | | | | | | | | | | |
|---|---|---|---|---|---|---|---|---|---|---|---|---|---|---|
| Ala | Lys | Cys | Cys | Glu | Leu | Cys | Cys | Asn | Pro | Ala | Cys | Thr | Gly | D-Cys | — |
| Ala | Lys | Cys | Cys | Glu | Leu | Cys | Cys | Asn | Pro | Ala | Cys | Thr | Gly | D-Cys | Lys |
| Ala | Lys | Cys | Cys | Glu | Leu | Cys | Cys | Asn | Pro | Ala | Cys | Thr | Gly | D-Cys | Tyr |
| Ala | Lys | Cys | Cys | Glu | Leu | Cys | Cys | Thr | Pro | Ala | Cys | Thr | Gly | Cys | — |
| Ala | Lys | Cys | Cys | Glu | Leu | Cys | Cys | Thr | Pro | Ala | Cys | Thr | Gly | Cys | Lys |
| Ala | Lys | Cys | Cys | Glu | Leu | Cys | Cys | Thr | Pro | Ala | Cys | Thr | Gly | Cys | Tyr |
| Ala | Lys | Cys | Cys | Glu | Leu | Cys | Cys | Thr | Pro | Ala | Cys | Thr | Gly | D-Cys | — |
| Ala | Lys | Cys | Cys | Glu | Leu | Cys | Cys | Thr | Pro | Ala | Cys | Thr | Gly | D-Cys | Lys |
| Ala | Lys | Cys | Cys | Glu | Leu | Cys | Cys | Thr | Pro | Ala | Cys | Thr | Gly | D-Cys | Tyr |
| Ala | Lys | Cys | Cys | Glu | Leu | D-Cys | Cys | Asn | Pro | Ala | Cys | Thr | Gly | Cys | — |
| Ala | Lys | Cys | Cys | Glu | Leu | D-Cys | Cys | Asn | Pro | Ala | Cys | Thr | Gly | Cys | Lys |
| Ala | Lys | Cys | Cys | Glu | Leu | D-Cys | Cys | Asn | Pro | Ala | Cys | Thr | Gly | Cys | Tyr |
| Ala | Lys | Cys | Cys | Glu | Leu | D-Cys | Cys | Asn | Pro | Ala | Cys | Thr | Gly | D-Cys | — |
| Ala | Lys | Cys | Cys | Glu | Leu | D-Cys | Cys | Asn | Pro | Ala | Cys | Thr | Gly | D-Cys | Lys |
| Ala | Lys | Cys | Cys | Glu | Leu | D-Cys | Cys | Asn | Pro | Ala | Cys | Thr | Gly | D-Cys | Tyr |
| Ala | Lys | Cys | Cys | Glu | Leu | D-Cys | Cys | Thr | Pro | Ala | Cys | Thr | Gly | Cys | — |
| Ala | Lys | Cys | Cys | Glu | Leu | D-Cys | Cys | Thr | Pro | Ala | Cys | Thr | Gly | Cys | Lys |
| Ala | Lys | Cys | Cys | Glu | Leu | D-Cys | Cys | Thr | Pro | Ala | Cys | Thr | Gly | Cys | Tyr |
| Ala | Lys | Cys | Cys | Glu | Leu | D-Cys | Cys | Thr | Pro | Ala | Cys | Thr | Gly | D-Cys | — |
| Ala | Lys | Cys | Cys | Glu | Leu | D-Cys | Cys | Thr | Pro | Ala | Cys | Thr | Gly | D-Cys | Lys |
| Ala | Lys | Cys | Cys | Glu | Leu | D-Cys | Cys | Thr | Pro | Ala | Cys | Thr | Gly | D-Cys | Tyr |
| Ala | Lys | Cys | Cys | Glu | Tyr | Cys | Cys | Asn | Pro | Ala | Cys | Thr | Gly | Cys | — |
| Ala | Lys | Cys | Cys | Glu | Tyr | Cys | Cys | Asn | Pro | Ala | Cys | Thr | Gly | Cys | Lys |
| Ala | Lys | Cys | Cys | Glu | Tyr | Cys | Cys | Asn | Pro | Ala | Cys | Thr | Gly | Cys | Tyr |
| Ala | Lys | Cys | Cys | Glu | Tyr | Cys | Cys | Asn | Pro | Ala | Cys | Thr | Gly | D-Cys | — |
| Ala | Lys | Cys | Cys | Glu | Tyr | Cys | Cys | Asn | Pro | Ala | Cys | Thr | Gly | D-Cys | Lys |
| Ala | Lys | Cys | Cys | Glu | Tyr | Cys | Cys | Asn | Pro | Ala | Cys | Thr | Gly | D-Cys | Tyr |
| Ala | Lys | Cys | Cys | Glu | Tyr | Cys | Cys | Thr | Pro | Ala | Cys | Thr | Gly | Cys | — |
| Ala | Lys | Cys | Cys | Glu | Tyr | Cys | Cys | Thr | Pro | Ala | Cys | Thr | Gly | Cys | Lys |
| Ala | Lys | Cys | Cys | Glu | Tyr | Cys | Cys | Thr | Pro | Ala | Cys | Thr | Gly | Cys | Tyr |
| Ala | Lys | Cys | Cys | Glu | Tyr | Cys | Cys | Thr | Pro | Ala | Cys | Thr | Gly | D-Cys | — |
| Ala | Lys | Cys | Cys | Glu | Tyr | Cys | Cys | Thr | Pro | Ala | Cys | Thr | Gly | D-Cys | Lys |
| Ala | Lys | Cys | Cys | Glu | Tyr | Cys | Cys | Thr | Pro | Ala | Cys | Thr | Gly | D-Cys | Tyr |
| Ala | Lys | Cys | Cys | Glu | Tyr | D-Cys | Cys | Asn | Pro | Ala | Cys | Thr | Gly | Cys | — |
| Ala | Lys | Cys | Cys | Glu | Tyr | D-Cys | Cys | Asn | Pro | Ala | Cys | Thr | Gly | Cys | Lys |
| Ala | Lys | Cys | Cys | Glu | Tyr | D-Cys | Cys | Asn | Pro | Ala | Cys | Thr | Gly | Cys | Tyr |
| Ala | Lys | Cys | Cys | Glu | Tyr | D-Cys | Cys | Asn | Pro | Ala | Cys | Thr | Gly | D-Cys | — |
| Ala | Lys | Cys | Cys | Glu | Tyr | D-Cys | Cys | Asn | Pro | Ala | Cys | Thr | Gly | D-Cys | Lys |
| Ala | Lys | Cys | Cys | Glu | Tyr | D-Cys | Cys | Asn | Pro | Ala | Cys | Thr | Gly | D-Cys | Tyr |
| Ala | Lys | Cys | Cys | Glu | Tyr | D-Cys | Cys | Thr | Pro | Ala | Cys | Thr | Gly | Cys | — |
| Ala | Lys | Cys | Cys | Glu | Tyr | D-Cys | Cys | Thr | Pro | Ala | Cys | Thr | Gly | Cys | Lys |
| Ala | Lys | Cys | Cys | Glu | Tyr | D-Cys | Cys | Thr | Pro | Ala | Cys | Thr | Gly | Cys | Tyr |
| Ala | Lys | Cys | Cys | Glu | Tyr | D-Cys | Cys | Thr | Pro | Ala | Cys | Thr | Gly | D-Cys | — |
| Ala | Lys | Cys | Cys | Glu | Tyr | D-Cys | Cys | Thr | Pro | Ala | Cys | Thr | Gly | D-Cys | Lys |
| Ala | Lys | Cys | Cys | Glu | Tyr | D-Cys | Cys | Thr | Pro | Ala | Cys | Thr | Gly | D-Cys | Tyr |
| Ala | Lys | Cys | Cys | Glu | Phe | Cys | Cys | Asn | Pro | Ala | Cys | Thr | Gly | Cys | — |
| Ala | Lys | Cys | Cys | Glu | Phe | Cys | Cys | Asn | Pro | Ala | Cys | Thr | Gly | Cys | Lys |
| Ala | Lys | Cys | Cys | Glu | Phe | Cys | Cys | Asn | Pro | Ala | Cys | Thr | Gly | Cys | Tyr |
| Ala | Lys | Cys | Cys | Glu | Phe | Cys | Cys | Asn | Pro | Ala | Cys | Thr | Gly | D-Cys | — |
| Ala | Lys | Cys | Cys | Glu | Phe | Cys | Cys | Asn | Pro | Ala | Cys | Thr | Gly | D-Cys | Lys |
| Ala | Lys | Cys | Cys | Glu | Phe | Cys | Cys | Asn | Pro | Ala | Cys | Thr | Gly | D-Cys | Tyr |
| Ala | Lys | Cys | Cys | Glu | Phe | Cys | Cys | Thr | Pro | Ala | Cys | Thr | Gly | Cys | — |
| Ala | Lys | Cys | Cys | Glu | Phe | Cys | Cys | Thr | Pro | Ala | Cys | Thr | Gly | Cys | Lys |
| Ala | Lys | Cys | Cys | Glu | Phe | Cys | Cys | Thr | Pro | Ala | Cys | Thr | Gly | Cys | Tyr |
| Ala | Lys | Cys | Cys | Glu | Phe | Cys | Cys | Thr | Pro | Ala | Cys | Thr | Gly | D-Cys | — |
| Ala | Lys | Cys | Cys | Glu | Phe | Cys | Cys | Thr | Pro | Ala | Cys | Thr | Gly | D-Cys | Lys |
| Ala | Lys | Cys | Cys | Glu | Phe | Cys | Cys | Thr | Pro | Ala | Cys | Thr | Gly | D-Cys | Tyr |
| Ala | Lys | Cys | Cys | Glu | Phe | D-Cys | Cys | Asn | Pro | Ala | Cys | Thr | Gly | Cys | — |
| Ala | Lys | Cys | Cys | Glu | Phe | D-Cys | Cys | Asn | Pro | Ala | Cys | Thr | Gly | Cys | Lys |
| Ala | Lys | Cys | Cys | Glu | Phe | D-Cys | Cys | Asn | Pro | Ala | Cys | Thr | Gly | Cys | Tyr |

FIG. 3A-45

| | | | | | | | | | | | | | | |
|---|---|---|---|---|---|---|---|---|---|---|---|---|---|---|
| Ala | Lys | Cys | Cys | Glu | Phe | D-Cys | Cys | Asn | Pro | Ala | Cys | Thr | Gly | D-Cys | — |
| Ala | Lys | Cys | Cys | Glu | Phe | D-Cys | Cys | Asn | Pro | Ala | Cys | Thr | Gly | D-Cys | Lys |
| Ala | Lys | Cys | Cys | Glu | Phe | D-Cys | Cys | Asn | Pro | Ala | Cys | Thr | Gly | D-Cys | Tyr |
| Ala | Lys | Cys | Cys | Glu | Phe | D-Cys | Cys | Thr | Pro | Ala | Cys | Thr | Gly | Cys | — |
| Ala | Lys | Cys | Cys | Glu | Phe | D-Cys | Cys | Thr | Pro | Ala | Cys | Thr | Gly | Cys | Lys |
| Ala | Lys | Cys | Cys | Glu | Phe | D-Cys | Cys | Thr | Pro | Ala | Cys | Thr | Gly | Cys | Tyr |
| Ala | Lys | Cys | Cys | Glu | Phe | D-Cys | Cys | Thr | Pro | Ala | Cys | Thr | Gly | D-Cys | — |
| Ala | Lys | Cys | Cys | Glu | Phe | D-Cys | Cys | Thr | Pro | Ala | Cys | Thr | Gly | D-Cys | Lys |
| Ala | Lys | Cys | Cys | Glu | Phe | D-Cys | Cys | Thr | Pro | Ala | Cys | Thr | Gly | D-Cys | Tyr |
| Ala | Lys | Cys | Cys | Glu | Trp | Cys | Cys | Asn | Pro | Ala | Cys | Thr | Gly | Cys | — |
| Ala | Lys | Cys | Cys | Glu | Trp | Cys | Cys | Asn | Pro | Ala | Cys | Thr | Gly | Cys | Lys |
| Ala | Lys | Cys | Cys | Glu | Trp | Cys | Cys | Asn | Pro | Ala | Cys | Thr | Gly | Cys | Tyr |
| Ala | Lys | Cys | Cys | Glu | Trp | Cys | Cys | Asn | Pro | Ala | Cys | Thr | Gly | D-Cys | — |
| Ala | Lys | Cys | Cys | Glu | Trp | Cys | Cys | Asn | Pro | Ala | Cys | Thr | Gly | D-Cys | Lys |
| Ala | Lys | Cys | Cys | Glu | Trp | Cys | Cys | Asn | Pro | Ala | Cys | Thr | Gly | D-Cys | Tyr |
| Ala | Lys | Cys | Cys | Glu | Trp | Cys | Cys | Thr | Pro | Ala | Cys | Thr | Gly | Cys | — |
| Ala | Lys | Cys | Cys | Glu | Trp | Cys | Cys | Thr | Pro | Ala | Cys | Thr | Gly | Cys | Lys |
| Ala | Lys | Cys | Cys | Glu | Trp | Cys | Cys | Thr | Pro | Ala | Cys | Thr | Gly | Cys | Tyr |
| Ala | Lys | Cys | Cys | Glu | Trp | Cys | Cys | Thr | Pro | Ala | Cys | Thr | Gly | D-Cys | — |
| Ala | Lys | Cys | Cys | Glu | Trp | Cys | Cys | Thr | Pro | Ala | Cys | Thr | Gly | D-Cys | Lys |
| Ala | Lys | Cys | Cys | Glu | Trp | Cys | Cys | Thr | Pro | Ala | Cys | Thr | Gly | D-Cys | Tyr |
| Ala | Lys | Cys | Cys | Glu | Trp | D-Cys | Cys | Asn | Pro | Ala | Cys | Thr | Gly | Cys | — |
| Ala | Lys | Cys | Cys | Glu | Trp | D-Cys | Cys | Asn | Pro | Ala | Cys | Thr | Gly | Cys | Lys |
| Ala | Lys | Cys | Cys | Glu | Trp | D-Cys | Cys | Asn | Pro | Ala | Cys | Thr | Gly | Cys | Tyr |
| Ala | Lys | Cys | Cys | Glu | Trp | D-Cys | Cys | Asn | Pro | Ala | Cys | Thr | Gly | D-Cys | — |
| Ala | Lys | Cys | Cys | Glu | Trp | D-Cys | Cys | Asn | Pro | Ala | Cys | Thr | Gly | D-Cys | Lys |
| Ala | Lys | Cys | Cys | Glu | Trp | D-Cys | Cys | Asn | Pro | Ala | Cys | Thr | Gly | D-Cys | Tyr |
| Ala | Lys | Cys | Cys | Glu | Trp | D-Cys | Cys | Thr | Pro | Ala | Cys | Thr | Gly | Cys | — |
| Ala | Lys | Cys | Cys | Glu | Trp | D-Cys | Cys | Thr | Pro | Ala | Cys | Thr | Gly | Cys | Lys |
| Ala | Lys | Cys | Cys | Glu | Trp | D-Cys | Cys | Thr | Pro | Ala | Cys | Thr | Gly | Cys | Tyr |
| Ala | Lys | Cys | Cys | Glu | Trp | D-Cys | Cys | Thr | Pro | Ala | Cys | Thr | Gly | D-Cys | — |
| Ala | Lys | Cys | Cys | Glu | Trp | D-Cys | Cys | Thr | Pro | Ala | Cys | Thr | Gly | D-Cys | Lys |
| Ala | Lys | Cys | Cys | Glu | Trp | D-Cys | Cys | Thr | Pro | Ala | Cys | Thr | Gly | D-Cys | Tyr |
| Ala | Lys | D-Cys | Cys | Glu | Val | Cys | Cys | Asn | Pro | Ala | Cys | Thr | Gly | Cys | — |
| Ala | Lys | D-Cys | Cys | Glu | Val | Cys | Cys | Asn | Pro | Ala | Cys | Thr | Gly | Cys | Lys |
| Ala | Lys | D-Cys | Cys | Glu | Val | Cys | Cys | Asn | Pro | Ala | Cys | Thr | Gly | Cys | Tyr |
| Ala | Lys | D-Cys | Cys | Glu | Val | Cys | Cys | Asn | Pro | Ala | Cys | Thr | Gly | D-Cys | — |
| Ala | Lys | D-Cys | Cys | Glu | Val | Cys | Cys | Asn | Pro | Ala | Cys | Thr | Gly | D-Cys | Lys |
| Ala | Lys | D-Cys | Cys | Glu | Val | Cys | Cys | Asn | Pro | Ala | Cys | Thr | Gly | D-Cys | Tyr |
| Ala | Lys | D-Cys | Cys | Glu | Val | Cys | Cys | Thr | Pro | Ala | Cys | Thr | Gly | Cys | — |
| Ala | Lys | D-Cys | Cys | Glu | Val | Cys | Cys | Thr | Pro | Ala | Cys | Thr | Gly | Cys | Lys |
| Ala | Lys | D-Cys | Cys | Glu | Val | Cys | Cys | Thr | Pro | Ala | Cys | Thr | Gly | Cys | Tyr |
| Ala | Lys | D-Cys | Cys | Glu | Val | Cys | Cys | Thr | Pro | Ala | Cys | Thr | Gly | D-Cys | — |
| Ala | Lys | D-Cys | Cys | Glu | Val | Cys | Cys | Thr | Pro | Ala | Cys | Thr | Gly | D-Cys | Lys |
| Ala | Lys | D-Cys | Cys | Glu | Val | Cys | Cys | Thr | Pro | Ala | Cys | Thr | Gly | D-Cys | Tyr |
| Ala | Lys | D-Cys | Cys | Glu | Val | D-Cys | Cys | Asn | Pro | Ala | Cys | Thr | Gly | Cys | — |
| Ala | Lys | D-Cys | Cys | Glu | Val | D-Cys | Cys | Asn | Pro | Ala | Cys | Thr | Gly | Cys | Lys |
| Ala | Lys | D-Cys | Cys | Glu | Val | D-Cys | Cys | Asn | Pro | Ala | Cys | Thr | Gly | Cys | Tyr |
| Ala | Lys | D-Cys | Cys | Glu | Val | D-Cys | Cys | Asn | Pro | Ala | Cys | Thr | Gly | D-Cys | — |
| Ala | Lys | D-Cys | Cys | Glu | Val | D-Cys | Cys | Asn | Pro | Ala | Cys | Thr | Gly | D-Cys | Lys |
| Ala | Lys | D-Cys | Cys | Glu | Val | D-Cys | Cys | Asn | Pro | Ala | Cys | Thr | Gly | D-Cys | Tyr |
| Ala | Lys | D-Cys | Cys | Glu | Val | D-Cys | Cys | Thr | Pro | Ala | Cys | Thr | Gly | Cys | — |
| Ala | Lys | D-Cys | Cys | Glu | Val | D-Cys | Cys | Thr | Pro | Ala | Cys | Thr | Gly | Cys | Lys |
| Ala | Lys | D-Cys | Cys | Glu | Val | D-Cys | Cys | Thr | Pro | Ala | Cys | Thr | Gly | Cys | Tyr |
| Ala | Lys | D-Cys | Cys | Glu | Val | D-Cys | Cys | Thr | Pro | Ala | Cys | Thr | Gly | D-Cys | — |
| Ala | Lys | D-Cys | Cys | Glu | Val | D-Cys | Cys | Thr | Pro | Ala | Cys | Thr | Gly | D-Cys | Lys |
| Ala | Lys | D-Cys | Cys | Glu | Val | D-Cys | Cys | Thr | Pro | Ala | Cys | Thr | Gly | D-Cys | Tyr |
| Ala | Lys | D-Cys | Cys | Glu | Ile | Cys | Cys | Asn | Pro | Ala | Cys | Thr | Gly | Cys | — |
| Ala | Lys | D-Cys | Cys | Glu | Ile | Cys | Cys | Asn | Pro | Ala | Cys | Thr | Gly | Cys | Lys |
| Ala | Lys | D-Cys | Cys | Glu | Ile | Cys | Cys | Asn | Pro | Ala | Cys | Thr | Gly | Cys | Tyr |

FIG. 3A-46

| | | | | | | | | | | | | | | |
|---|---|---|---|---|---|---|---|---|---|---|---|---|---|---|
| Ala | Lys | D-Cys | Cys | Glu | Ile | Cys | Cys | Asn | Pro | Ala | Cys | Thr | Gly | D-Cys | — |
| Ala | Lys | D-Cys | Cys | Glu | Ile | Cys | Cys | Asn | Pro | Ala | Cys | Thr | Gly | D-Cys | Lys |
| Ala | Lys | D-Cys | Cys | Glu | Ile | Cys | Cys | Asn | Pro | Ala | Cys | Thr | Gly | D-Cys | Tyr |
| Ala | Lys | D-Cys | Cys | Glu | Ile | Cys | Cys | Thr | Pro | Ala | Cys | Thr | Gly | Cys | — |
| Ala | Lys | D-Cys | Cys | Glu | Ile | Cys | Cys | Thr | Pro | Ala | Cys | Thr | Gly | Cys | Lys |
| Ala | Lys | D-Cys | Cys | Glu | Ile | Cys | Cys | Thr | Pro | Ala | Cys | Thr | Gly | Cys | Tyr |
| Ala | Lys | D-Cys | Cys | Glu | Ile | Cys | Cys | Thr | Pro | Ala | Cys | Thr | Gly | D-Cys | — |
| Ala | Lys | D-Cys | Cys | Glu | Ile | Cys | Cys | Thr | Pro | Ala | Cys | Thr | Gly | D-Cys | Lys |
| Ala | Lys | D-Cys | Cys | Glu | Ile | Cys | Cys | Thr | Pro | Ala | Cys | Thr | Gly | D-Cys | Tyr |
| Ala | Lys | D-Cys | Cys | Glu | Ile | D-Cys | Cys | Asn | Pro | Ala | Cys | Thr | Gly | Cys | — |
| Ala | Lys | D-Cys | Cys | Glu | Ile | D-Cys | Cys | Asn | Pro | Ala | Cys | Thr | Gly | Cys | Lys |
| Ala | Lys | D-Cys | Cys | Glu | Ile | D-Cys | Cys | Asn | Pro | Ala | Cys | Thr | Gly | Cys | Tyr |
| Ala | Lys | D-Cys | Cys | Glu | Ile | D-Cys | Cys | Asn | Pro | Ala | Cys | Thr | Gly | D-Cys | — |
| Ala | Lys | D-Cys | Cys | Glu | Ile | D-Cys | Cys | Asn | Pro | Ala | Cys | Thr | Gly | D-Cys | Lys |
| Ala | Lys | D-Cys | Cys | Glu | Ile | D-Cys | Cys | Asn | Pro | Ala | Cys | Thr | Gly | D-Cys | Tyr |
| Ala | Lys | D-Cys | Cys | Glu | Ile | D-Cys | Cys | Thr | Pro | Ala | Cys | Thr | Gly | Cys | — |
| Ala | Lys | D-Cys | Cys | Glu | Ile | D-Cys | Cys | Thr | Pro | Ala | Cys | Thr | Gly | Cys | Lys |
| Ala | Lys | D-Cys | Cys | Glu | Ile | D-Cys | Cys | Thr | Pro | Ala | Cys | Thr | Gly | Cys | Tyr |
| Ala | Lys | D-Cys | Cys | Glu | Ile | D-Cys | Cys | Thr | Pro | Ala | Cys | Thr | Gly | D-Cys | — |
| Ala | Lys | D-Cys | Cys | Glu | Ile | D-Cys | Cys | Thr | Pro | Ala | Cys | Thr | Gly | D-Cys | Lys |
| Ala | Lys | D-Cys | Cys | Glu | Ile | D-Cys | Cys | Thr | Pro | Ala | Cys | Thr | Gly | D-Cys | Tyr |
| Ala | Lys | D-Cys | Cys | Glu | Leu | Cys | Cys | Asn | Pro | Ala | Cys | Thr | Gly | Cys | — |
| Ala | Lys | D-Cys | Cys | Glu | Leu | Cys | Cys | Asn | Pro | Ala | Cys | Thr | Gly | Cys | Lys |
| Ala | Lys | D-Cys | Cys | Glu | Leu | Cys | Cys | Asn | Pro | Ala | Cys | Thr | Gly | Cys | Tyr |
| Ala | Lys | D-Cys | Cys | Glu | Leu | Cys | Cys | Asn | Pro | Ala | Cys | Thr | Gly | D-Cys | — |
| Ala | Lys | D-Cys | Cys | Glu | Leu | Cys | Cys | Asn | Pro | Ala | Cys | Thr | Gly | D-Cys | Lys |
| Ala | Lys | D-Cys | Cys | Glu | Leu | Cys | Cys | Asn | Pro | Ala | Cys | Thr | Gly | D-Cys | Tyr |
| Ala | Lys | D-Cys | Cys | Glu | Leu | Cys | Cys | Thr | Pro | Ala | Cys | Thr | Gly | Cys | — |
| Ala | Lys | D-Cys | Cys | Glu | Leu | Cys | Cys | Thr | Pro | Ala | Cys | Thr | Gly | Cys | Lys |
| Ala | Lys | D-Cys | Cys | Glu | Leu | Cys | Cys | Thr | Pro | Ala | Cys | Thr | Gly | Cys | Tyr |
| Ala | Lys | D-Cys | Cys | Glu | Leu | Cys | Cys | Thr | Pro | Ala | Cys | Thr | Gly | D-Cys | — |
| Ala | Lys | D-Cys | Cys | Glu | Leu | Cys | Cys | Thr | Pro | Ala | Cys | Thr | Gly | D-Cys | Lys |
| Ala | Lys | D-Cys | Cys | Glu | Leu | Cys | Cys | Thr | Pro | Ala | Cys | Thr | Gly | D-Cys | Tyr |
| Ala | Lys | D-Cys | Cys | Glu | Leu | D-Cys | Cys | Asn | Pro | Ala | Cys | Thr | Gly | Cys | — |
| Ala | Lys | D-Cys | Cys | Glu | Leu | D-Cys | Cys | Asn | Pro | Ala | Cys | Thr | Gly | Cys | Lys |
| Ala | Lys | D-Cys | Cys | Glu | Leu | D-Cys | Cys | Asn | Pro | Ala | Cys | Thr | Gly | Cys | Tyr |
| Ala | Lys | D-Cys | Cys | Glu | Leu | D-Cys | Cys | Asn | Pro | Ala | Cys | Thr | Gly | D-Cys | — |
| Ala | Lys | D-Cys | Cys | Glu | Leu | D-Cys | Cys | Asn | Pro | Ala | Cys | Thr | Gly | D-Cys | Lys |
| Ala | Lys | D-Cys | Cys | Glu | Leu | D-Cys | Cys | Asn | Pro | Ala | Cys | Thr | Gly | D-Cys | Tyr |
| Ala | Lys | D-Cys | Cys | Glu | Leu | D-Cys | Cys | Thr | Pro | Ala | Cys | Thr | Gly | Cys | — |
| Ala | Lys | D-Cys | Cys | Glu | Leu | D-Cys | Cys | Thr | Pro | Ala | Cys | Thr | Gly | Cys | Lys |
| Ala | Lys | D-Cys | Cys | Glu | Leu | D-Cys | Cys | Thr | Pro | Ala | Cys | Thr | Gly | Cys | Tyr |
| Ala | Lys | D-Cys | Cys | Glu | Leu | D-Cys | Cys | Thr | Pro | Ala | Cys | Thr | Gly | D-Cys | — |
| Ala | Lys | D-Cys | Cys | Glu | Leu | D-Cys | Cys | Thr | Pro | Ala | Cys | Thr | Gly | D-Cys | Lys |
| Ala | Lys | D-Cys | Cys | Glu | Leu | D-Cys | Cys | Thr | Pro | Ala | Cys | Thr | Gly | D-Cys | Tyr |
| Ala | Lys | D-Cys | Cys | Glu | Tyr | Cys | Cys | Asn | Pro | Ala | Cys | Thr | Gly | Cys | — |
| Ala | Lys | D-Cys | Cys | Glu | Tyr | Cys | Cys | Asn | Pro | Ala | Cys | Thr | Gly | Cys | Lys |
| Ala | Lys | D-Cys | Cys | Glu | Tyr | Cys | Cys | Asn | Pro | Ala | Cys | Thr | Gly | Cys | Tyr |
| Ala | Lys | D-Cys | Cys | Glu | Tyr | Cys | Cys | Asn | Pro | Ala | Cys | Thr | Gly | D-Cys | — |
| Ala | Lys | D-Cys | Cys | Glu | Tyr | Cys | Cys | Asn | Pro | Ala | Cys | Thr | Gly | D-Cys | Lys |
| Ala | Lys | D-Cys | Cys | Glu | Tyr | Cys | Cys | Asn | Pro | Ala | Cys | Thr | Gly | D-Cys | Tyr |
| Ala | Lys | D-Cys | Cys | Glu | Tyr | Cys | Cys | Thr | Pro | Ala | Cys | Thr | Gly | Cys | — |
| Ala | Lys | D-Cys | Cys | Glu | Tyr | Cys | Cys | Thr | Pro | Ala | Cys | Thr | Gly | Cys | Lys |
| Ala | Lys | D-Cys | Cys | Glu | Tyr | Cys | Cys | Thr | Pro | Ala | Cys | Thr | Gly | Cys | Tyr |
| Ala | Lys | D-Cys | Cys | Glu | Tyr | Cys | Cys | Thr | Pro | Ala | Cys | Thr | Gly | D-Cys | — |
| Ala | Lys | D-Cys | Cys | Glu | Tyr | Cys | Cys | Thr | Pro | Ala | Cys | Thr | Gly | D-Cys | Lys |
| Ala | Lys | D-Cys | Cys | Glu | Tyr | Cys | Cys | Thr | Pro | Ala | Cys | Thr | Gly | D-Cys | Tyr |
| Ala | Lys | D-Cys | Cys | Glu | Tyr | D-Cys | Cys | Asn | Pro | Ala | Cys | Thr | Gly | Cys | — |
| Ala | Lys | D-Cys | Cys | Glu | Tyr | D-Cys | Cys | Asn | Pro | Ala | Cys | Thr | Gly | Cys | Lys |
| Ala | Lys | D-Cys | Cys | Glu | Tyr | D-Cys | Cys | Asn | Pro | Ala | Cys | Thr | Gly | Cys | Tyr |

FIG. 3A-47

| Ala | Lys | D-Cys | Cys | Glu | Tyr | D-Cys | Cys | Asn | Pro | Ala | Cys | Thr | Gly | D-Cys | — |
|---|---|---|---|---|---|---|---|---|---|---|---|---|---|---|---|
| Ala | Lys | D-Cys | Cys | Glu | Tyr | D-Cys | Cys | Asn | Pro | Ala | Cys | Thr | Gly | D-Cys | Lys |
| Ala | Lys | D-Cys | Cys | Glu | Tyr | D-Cys | Cys | Asn | Pro | Ala | Cys | Thr | Gly | D-Cys | Tyr |
| Ala | Lys | D-Cys | Cys | Glu | Tyr | D-Cys | Cys | Thr | Pro | Ala | Cys | Thr | Gly | Cys | — |
| Ala | Lys | D-Cys | Cys | Glu | Tyr | D-Cys | Cys | Thr | Pro | Ala | Cys | Thr | Gly | Cys | Lys |
| Ala | Lys | D-Cys | Cys | Glu | Tyr | D-Cys | Cys | Thr | Pro | Ala | Cys | Thr | Gly | Cys | Tyr |
| Ala | Lys | D-Cys | Cys | Glu | Tyr | D-Cys | Cys | Thr | Pro | Ala | Cys | Thr | Gly | D-Cys | — |
| Ala | Lys | D-Cys | Cys | Glu | Tyr | D-Cys | Cys | Thr | Pro | Ala | Cys | Thr | Gly | D-Cys | Lys |
| Ala | Lys | D-Cys | Cys | Glu | Tyr | D-Cys | Cys | Thr | Pro | Ala | Cys | Thr | Gly | D-Cys | Tyr |
| Ala | Lys | D-Cys | Cys | Glu | Phe | Cys | Cys | Asn | Pro | Ala | Cys | Thr | Gly | Cys | — |
| Ala | Lys | D-Cys | Cys | Glu | Phe | Cys | Cys | Asn | Pro | Ala | Cys | Thr | Gly | Cys | Lys |
| Ala | Lys | D-Cys | Cys | Glu | Phe | Cys | Cys | Asn | Pro | Ala | Cys | Thr | Gly | Cys | Tyr |
| Ala | Lys | D-Cys | Cys | Glu | Phe | Cys | Cys | Asn | Pro | Ala | Cys | Thr | Gly | D-Cys | — |
| Ala | Lys | D-Cys | Cys | Glu | Phe | Cys | Cys | Asn | Pro | Ala | Cys | Thr | Gly | D-Cys | Lys |
| Ala | Lys | D-Cys | Cys | Glu | Phe | Cys | Cys | Asn | Pro | Ala | Cys | Thr | Gly | D-Cys | Tyr |
| Ala | Lys | D-Cys | Cys | Glu | Phe | Cys | Cys | Thr | Pro | Ala | Cys | Thr | Gly | Cys | — |
| Ala | Lys | D-Cys | Cys | Glu | Phe | Cys | Cys | Thr | Pro | Ala | Cys | Thr | Gly | Cys | Lys |
| Ala | Lys | D-Cys | Cys | Glu | Phe | Cys | Cys | Thr | Pro | Ala | Cys | Thr | Gly | Cys | Tyr |
| Ala | Lys | D-Cys | Cys | Glu | Phe | Cys | Cys | Thr | Pro | Ala | Cys | Thr | Gly | D-Cys | — |
| Ala | Lys | D-Cys | Cys | Glu | Phe | Cys | Cys | Thr | Pro | Ala | Cys | Thr | Gly | D-Cys | Lys |
| Ala | Lys | D-Cys | Cys | Glu | Phe | Cys | Cys | Thr | Pro | Ala | Cys | Thr | Gly | D-Cys | Tyr |
| Ala | Lys | D-Cys | Cys | Glu | Phe | D-Cys | Cys | Asn | Pro | Ala | Cys | Thr | Gly | Cys | — |
| Ala | Lys | D-Cys | Cys | Glu | Phe | D-Cys | Cys | Asn | Pro | Ala | Cys | Thr | Gly | Cys | Lys |
| Ala | Lys | D-Cys | Cys | Glu | Phe | D-Cys | Cys | Asn | Pro | Ala | Cys | Thr | Gly | Cys | Tyr |
| Ala | Lys | D-Cys | Cys | Glu | Phe | D-Cys | Cys | Asn | Pro | Ala | Cys | Thr | Gly | D-Cys | — |
| Ala | Lys | D-Cys | Cys | Glu | Phe | D-Cys | Cys | Asn | Pro | Ala | Cys | Thr | Gly | D-Cys | Lys |
| Ala | Lys | D-Cys | Cys | Glu | Phe | D-Cys | Cys | Asn | Pro | Ala | Cys | Thr | Gly | D-Cys | Tyr |
| Ala | Lys | D-Cys | Cys | Glu | Phe | D-Cys | Cys | Thr | Pro | Ala | Cys | Thr | Gly | Cys | — |
| Ala | Lys | D-Cys | Cys | Glu | Phe | D-Cys | Cys | Thr | Pro | Ala | Cys | Thr | Gly | Cys | Lys |
| Ala | Lys | D-Cys | Cys | Glu | Phe | D-Cys | Cys | Thr | Pro | Ala | Cys | Thr | Gly | Cys | Tyr |
| Ala | Lys | D-Cys | Cys | Glu | Phe | D-Cys | Cys | Thr | Pro | Ala | Cys | Thr | Gly | D-Cys | — |
| Ala | Lys | D-Cys | Cys | Glu | Phe | D-Cys | Cys | Thr | Pro | Ala | Cys | Thr | Gly | D-Cys | Lys |
| Ala | Lys | D-Cys | Cys | Glu | Phe | D-Cys | Cys | Thr | Pro | Ala | Cys | Thr | Gly | D-Cys | Tyr |
| Ala | Lys | D-Cys | Cys | Glu | Trp | Cys | Cys | Asn | Pro | Ala | Cys | Thr | Gly | Cys | — |
| Ala | Lys | D-Cys | Cys | Glu | Trp | Cys | Cys | Asn | Pro | Ala | Cys | Thr | Gly | Cys | Lys |
| Ala | Lys | D-Cys | Cys | Glu | Trp | Cys | Cys | Asn | Pro | Ala | Cys | Thr | Gly | Cys | Tyr |
| Ala | Lys | D-Cys | Cys | Glu | Trp | Cys | Cys | Asn | Pro | Ala | Cys | Thr | Gly | D-Cys | — |
| Ala | Lys | D-Cys | Cys | Glu | Trp | Cys | Cys | Asn | Pro | Ala | Cys | Thr | Gly | D-Cys | Lys |
| Ala | Lys | D-Cys | Cys | Glu | Trp | Cys | Cys | Asn | Pro | Ala | Cys | Thr | Gly | D-Cys | Tyr |
| Ala | Lys | D-Cys | Cys | Glu | Trp | Cys | Cys | Thr | Pro | Ala | Cys | Thr | Gly | Cys | — |
| Ala | Lys | D-Cys | Cys | Glu | Trp | Cys | Cys | Thr | Pro | Ala | Cys | Thr | Gly | Cys | Lys |
| Ala | Lys | D-Cys | Cys | Glu | Trp | Cys | Cys | Thr | Pro | Ala | Cys | Thr | Gly | Cys | Tyr |
| Ala | Lys | D-Cys | Cys | Glu | Trp | Cys | Cys | Thr | Pro | Ala | Cys | Thr | Gly | D-Cys | — |
| Ala | Lys | D-Cys | Cys | Glu | Trp | Cys | Cys | Thr | Pro | Ala | Cys | Thr | Gly | D-Cys | Lys |
| Ala | Lys | D-Cys | Cys | Glu | Trp | Cys | Cys | Thr | Pro | Ala | Cys | Thr | Gly | D-Cys | Tyr |
| Ala | Lys | D-Cys | Cys | Glu | Trp | D-Cys | Cys | Asn | Pro | Ala | Cys | Thr | Gly | Cys | — |
| Ala | Lys | D-Cys | Cys | Glu | Trp | D-Cys | Cys | Asn | Pro | Ala | Cys | Thr | Gly | Cys | Lys |
| Ala | Lys | D-Cys | Cys | Glu | Trp | D-Cys | Cys | Asn | Pro | Ala | Cys | Thr | Gly | Cys | Tyr |
| Ala | Lys | D-Cys | Cys | Glu | Trp | D-Cys | Cys | Asn | Pro | Ala | Cys | Thr | Gly | D-Cys | — |
| Ala | Lys | D-Cys | Cys | Glu | Trp | D-Cys | Cys | Asn | Pro | Ala | Cys | Thr | Gly | D-Cys | Lys |
| Ala | Lys | D-Cys | Cys | Glu | Trp | D-Cys | Cys | Asn | Pro | Ala | Cys | Thr | Gly | D-Cys | Tyr |
| Ala | Lys | D-Cys | Cys | Glu | Trp | D-Cys | Cys | Thr | Pro | Ala | Cys | Thr | Gly | Cys | — |
| Ala | Lys | D-Cys | Cys | Glu | Trp | D-Cys | Cys | Thr | Pro | Ala | Cys | Thr | Gly | Cys | Lys |
| Ala | Lys | D-Cys | Cys | Glu | Trp | D-Cys | Cys | Thr | Pro | Ala | Cys | Thr | Gly | Cys | Tyr |
| Ala | Lys | D-Cys | Cys | Glu | Trp | D-Cys | Cys | Thr | Pro | Ala | Cys | Thr | Gly | D-Cys | — |
| Ala | Lys | D-Cys | Cys | Glu | Trp | D-Cys | Cys | Thr | Pro | Ala | Cys | Thr | Gly | D-Cys | Lys |
| Ala | Lys | D-Cys | Cys | Glu | Trp | D-Cys | Cys | Thr | Pro | Ala | Cys | Thr | Gly | D-Cys | Tyr |
| Ala | Ser | Cys | Cys | Glu | Val | Cys | Cys | Asn | Pro | Ala | Cys | Thr | Gly | Cys | — |
| Ala | Ser | Cys | Cys | Glu | Val | Cys | Cys | Asn | Pro | Ala | Cys | Thr | Gly | Cys | Lys |
| Ala | Ser | Cys | Cys | Glu | Val | Cys | Cys | Asn | Pro | Ala | Cys | Thr | Gly | Cys | Tyr |

FIG. 3A-48

| Ala | Ser | Cys | Cys | Glu | Val | Cys | Cys | Asn | Pro | Ala | Cys | Thr | Gly | D-Cys | — |
|---|---|---|---|---|---|---|---|---|---|---|---|---|---|---|---|
| Ala | Ser | Cys | Cys | Glu | Val | Cys | Cys | Asn | Pro | Ala | Cys | Thr | Gly | D-Cys | Lys |
| Ala | Ser | Cys | Cys | Glu | Val | Cys | Cys | Asn | Pro | Ala | Cys | Thr | Gly | D-Cys | Tyr |
| Ala | Ser | Cys | Cys | Glu | Val | Cys | Cys | Thr | Pro | Ala | Cys | Thr | Gly | Cys | — |
| Ala | Ser | Cys | Cys | Glu | Val | Cys | Cys | Thr | Pro | Ala | Cys | Thr | Gly | Cys | Lys |
| Ala | Ser | Cys | Cys | Glu | Val | Cys | Cys | Thr | Pro | Ala | Cys | Thr | Gly | Cys | Tyr |
| Ala | Ser | Cys | Cys | Glu | Val | Cys | Cys | Thr | Pro | Ala | Cys | Thr | Gly | D-Cys | — |
| Ala | Ser | Cys | Cys | Glu | Val | Cys | Cys | Thr | Pro | Ala | Cys | Thr | Gly | D-Cys | Lys |
| Ala | Ser | Cys | Cys | Glu | Val | Cys | Cys | Thr | Pro | Ala | Cys | Thr | Gly | D-Cys | Tyr |
| Ala | Ser | Cys | Cys | Glu | Val | D-Cys | Cys | Asn | Pro | Ala | Cys | Thr | Gly | Cys | — |
| Ala | Ser | Cys | Cys | Glu | Val | D-Cys | Cys | Asn | Pro | Ala | Cys | Thr | Gly | Cys | Lys |
| Ala | Ser | Cys | Cys | Glu | Val | D-Cys | Cys | Asn | Pro | Ala | Cys | Thr | Gly | Cys | Tyr |
| Ala | Ser | Cys | Cys | Glu | Val | D-Cys | Cys | Asn | Pro | Ala | Cys | Thr | Gly | D-Cys | — |
| Ala | Ser | Cys | Cys | Glu | Val | D-Cys | Cys | Asn | Pro | Ala | Cys | Thr | Gly | D-Cys | Lys |
| Ala | Ser | Cys | Cys | Glu | Val | D-Cys | Cys | Asn | Pro | Ala | Cys | Thr | Gly | D-Cys | Tyr |
| Ala | Ser | Cys | Cys | Glu | Val | D-Cys | Cys | Thr | Pro | Ala | Cys | Thr | Gly | Cys | — |
| Ala | Ser | Cys | Cys | Glu | Val | D-Cys | Cys | Thr | Pro | Ala | Cys | Thr | Gly | Cys | Lys |
| Ala | Ser | Cys | Cys | Glu | Val | D-Cys | Cys | Thr | Pro | Ala | Cys | Thr | Gly | Cys | Tyr |
| Ala | Ser | Cys | Cys | Glu | Val | D-Cys | Cys | Thr | Pro | Ala | Cys | Thr | Gly | D-Cys | — |
| Ala | Ser | Cys | Cys | Glu | Val | D-Cys | Cys | Thr | Pro | Ala | Cys | Thr | Gly | D-Cys | Lys |
| Ala | Ser | Cys | Cys | Glu | Val | D-Cys | Cys | Thr | Pro | Ala | Cys | Thr | Gly | D-Cys | Tyr |
| Ala | Ser | Cys | Cys | Glu | Ile | Cys | Cys | Asn | Pro | Ala | Cys | Thr | Gly | Cys | — |
| Ala | Ser | Cys | Cys | Glu | Ile | Cys | Cys | Asn | Pro | Ala | Cys | Thr | Gly | Cys | Lys |
| Ala | Ser | Cys | Cys | Glu | Ile | Cys | Cys | Asn | Pro | Ala | Cys | Thr | Gly | Cys | Tyr |
| Ala | Ser | Cys | Cys | Glu | Ile | Cys | Cys | Asn | Pro | Ala | Cys | Thr | Gly | D-Cys | — |
| Ala | Ser | Cys | Cys | Glu | Ile | Cys | Cys | Asn | Pro | Ala | Cys | Thr | Gly | D-Cys | Lys |
| Ala | Ser | Cys | Cys | Glu | Ile | Cys | Cys | Asn | Pro | Ala | Cys | Thr | Gly | D-Cys | Tyr |
| Ala | Ser | Cys | Cys | Glu | Ile | Cys | Cys | Thr | Pro | Ala | Cys | Thr | Gly | Cys | — |
| Ala | Ser | Cys | Cys | Glu | Ile | Cys | Cys | Thr | Pro | Ala | Cys | Thr | Gly | Cys | Lys |
| Ala | Ser | Cys | Cys | Glu | Ile | Cys | Cys | Thr | Pro | Ala | Cys | Thr | Gly | Cys | Tyr |
| Ala | Ser | Cys | Cys | Glu | Ile | Cys | Cys | Thr | Pro | Ala | Cys | Thr | Gly | D-Cys | — |
| Ala | Ser | Cys | Cys | Glu | Ile | Cys | Cys | Thr | Pro | Ala | Cys | Thr | Gly | D-Cys | Lys |
| Ala | Ser | Cys | Cys | Glu | Ile | Cys | Cys | Thr | Pro | Ala | Cys | Thr | Gly | D-Cys | Tyr |
| Ala | Ser | Cys | Cys | Glu | Ile | D-Cys | Cys | Asn | Pro | Ala | Cys | Thr | Gly | Cys | — |
| Ala | Ser | Cys | Cys | Glu | Ile | D-Cys | Cys | Asn | Pro | Ala | Cys | Thr | Gly | Cys | Lys |
| Ala | Ser | Cys | Cys | Glu | Ile | D-Cys | Cys | Asn | Pro | Ala | Cys | Thr | Gly | Cys | Tyr |
| Ala | Ser | Cys | Cys | Glu | Ile | D-Cys | Cys | Asn | Pro | Ala | Cys | Thr | Gly | D-Cys | — |
| Ala | Ser | Cys | Cys | Glu | Ile | D-Cys | Cys | Asn | Pro | Ala | Cys | Thr | Gly | D-Cys | Lys |
| Ala | Ser | Cys | Cys | Glu | Ile | D-Cys | Cys | Asn | Pro | Ala | Cys | Thr | Gly | D-Cys | Tyr |
| Ala | Ser | Cys | Cys | Glu | Ile | D-Cys | Cys | Thr | Pro | Ala | Cys | Thr | Gly | Cys | — |
| Ala | Ser | Cys | Cys | Glu | Ile | D-Cys | Cys | Thr | Pro | Ala | Cys | Thr | Gly | Cys | Lys |
| Ala | Ser | Cys | Cys | Glu | Ile | D-Cys | Cys | Thr | Pro | Ala | Cys | Thr | Gly | Cys | Tyr |
| Ala | Ser | Cys | Cys | Glu | Ile | D-Cys | Cys | Thr | Pro | Ala | Cys | Thr | Gly | D-Cys | — |
| Ala | Ser | Cys | Cys | Glu | Ile | D-Cys | Cys | Thr | Pro | Ala | Cys | Thr | Gly | D-Cys | Lys |
| Ala | Ser | Cys | Cys | Glu | Ile | D-Cys | Cys | Thr | Pro | Ala | Cys | Thr | Gly | D-Cys | Tyr |
| Ala | Ser | Cys | Cys | Glu | Leu | Cys | Cys | Asn | Pro | Ala | Cys | Thr | Gly | Cys | — |
| Ala | Ser | Cys | Cys | Glu | Leu | Cys | Cys | Asn | Pro | Ala | Cys | Thr | Gly | Cys | Lys |
| Ala | Ser | Cys | Cys | Glu | Leu | Cys | Cys | Asn | Pro | Ala | Cys | Thr | Gly | Cys | Tyr |
| Ala | Ser | Cys | Cys | Glu | Leu | Cys | Cys | Asn | Pro | Ala | Cys | Thr | Gly | D-Cys | — |
| Ala | Ser | Cys | Cys | Glu | Leu | Cys | Cys | Asn | Pro | Ala | Cys | Thr | Gly | D-Cys | Lys |
| Ala | Ser | Cys | Cys | Glu | Leu | Cys | Cys | Asn | Pro | Ala | Cys | Thr | Gly | D-Cys | Tyr |
| Ala | Ser | Cys | Cys | Glu | Leu | Cys | Cys | Thr | Pro | Ala | Cys | Thr | Gly | Cys | — |
| Ala | Ser | Cys | Cys | Glu | Leu | Cys | Cys | Thr | Pro | Ala | Cys | Thr | Gly | Cys | Lys |
| Ala | Ser | Cys | Cys | Glu | Leu | Cys | Cys | Thr | Pro | Ala | Cys | Thr | Gly | Cys | Tyr |
| Ala | Ser | Cys | Cys | Glu | Leu | Cys | Cys | Thr | Pro | Ala | Cys | Thr | Gly | D-Cys | — |
| Ala | Ser | Cys | Cys | Glu | Leu | Cys | Cys | Thr | Pro | Ala | Cys | Thr | Gly | D-Cys | Lys |
| Ala | Ser | Cys | Cys | Glu | Leu | Cys | Cys | Thr | Pro | Ala | Cys | Thr | Gly | D-Cys | Tyr |
| Ala | Ser | Cys | Cys | Glu | Leu | D-Cys | Cys | Asn | Pro | Ala | Cys | Thr | Gly | Cys | — |
| Ala | Ser | Cys | Cys | Glu | Leu | D-Cys | Cys | Asn | Pro | Ala | Cys | Thr | Gly | Cys | Lys |
| Ala | Ser | Cys | Cys | Glu | Leu | D-Cys | Cys | Asn | Pro | Ala | Cys | Thr | Gly | Cys | Tyr |

FIG. 3A-49

| | | | | | | | | | | | | | | | |
|---|---|---|---|---|---|---|---|---|---|---|---|---|---|---|---|
| Ala | Ser | Cys | Cys | Glu | Leu | D-Cys | Cys | Asn | Pro | Ala | Cys | Thr | Gly | D-Cys | — |
| Ala | Ser | Cys | Cys | Glu | Leu | D-Cys | Cys | Asn | Pro | Ala | Cys | Thr | Gly | D-Cys | Lys |
| Ala | Ser | Cys | Cys | Glu | Leu | D-Cys | Cys | Asn | Pro | Ala | Cys | Thr | Gly | D-Cys | Tyr |
| Ala | Ser | Cys | Cys | Glu | Leu | D-Cys | Cys | Thr | Pro | Ala | Cys | Thr | Gly | Cys | — |
| Ala | Ser | Cys | Cys | Glu | Leu | D-Cys | Cys | Thr | Pro | Ala | Cys | Thr | Gly | Cys | Lys |
| Ala | Ser | Cys | Cys | Glu | Leu | D-Cys | Cys | Thr | Pro | Ala | Cys | Thr | Gly | Cys | Tyr |
| Ala | Ser | Cys | Cys | Glu | Leu | D-Cys | Cys | Thr | Pro | Ala | Cys | Thr | Gly | D-Cys | — |
| Ala | Ser | Cys | Cys | Glu | Leu | D-Cys | Cys | Thr | Pro | Ala | Cys | Thr | Gly | D-Cys | Lys |
| Ala | Ser | Cys | Cys | Glu | Leu | D-Cys | Cys | Thr | Pro | Ala | Cys | Thr | Gly | D-Cys | Tyr |
| Ala | Ser | Cys | Cys | Glu | Tyr | Cys | Cys | Asn | Pro | Ala | Cys | Thr | Gly | Cys | — |
| Ala | Ser | Cys | Cys | Glu | Tyr | Cys | Cys | Asn | Pro | Ala | Cys | Thr | Gly | Cys | Lys |
| Ala | Ser | Cys | Cys | Glu | Tyr | Cys | Cys | Asn | Pro | Ala | Cys | Thr | Gly | Cys | Tyr |
| Ala | Ser | Cys | Cys | Glu | Tyr | Cys | Cys | Asn | Pro | Ala | Cys | Thr | Gly | D-Cys | — |
| Ala | Ser | Cys | Cys | Glu | Tyr | Cys | Cys | Asn | Pro | Ala | Cys | Thr | Gly | D-Cys | Lys |
| Ala | Ser | Cys | Cys | Glu | Tyr | Cys | Cys | Asn | Pro | Ala | Cys | Thr | Gly | D-Cys | Tyr |
| Ala | Ser | Cys | Cys | Glu | Tyr | Cys | Cys | Thr | Pro | Ala | Cys | Thr | Gly | Cys | — |
| Ala | Ser | Cys | Cys | Glu | Tyr | Cys | Cys | Thr | Pro | Ala | Cys | Thr | Gly | Cys | Lys |
| Ala | Ser | Cys | Cys | Glu | Tyr | Cys | Cys | Thr | Pro | Ala | Cys | Thr | Gly | Cys | Tyr |
| Ala | Ser | Cys | Cys | Glu | Tyr | Cys | Cys | Thr | Pro | Ala | Cys | Thr | Gly | D-Cys | — |
| Ala | Ser | Cys | Cys | Glu | Tyr | Cys | Cys | Thr | Pro | Ala | Cys | Thr | Gly | D-Cys | Lys |
| Ala | Ser | Cys | Cys | Glu | Tyr | Cys | Cys | Thr | Pro | Ala | Cys | Thr | Gly | D-Cys | Tyr |
| Ala | Ser | Cys | Cys | Glu | Tyr | D-Cys | Cys | Asn | Pro | Ala | Cys | Thr | Gly | Cys | — |
| Ala | Ser | Cys | Cys | Glu | Tyr | D-Cys | Cys | Asn | Pro | Ala | Cys | Thr | Gly | Cys | Lys |
| Ala | Ser | Cys | Cys | Glu | Tyr | D-Cys | Cys | Asn | Pro | Ala | Cys | Thr | Gly | Cys | Tyr |
| Ala | Ser | Cys | Cys | Glu | Tyr | D-Cys | Cys | Asn | Pro | Ala | Cys | Thr | Gly | D-Cys | — |
| Ala | Ser | Cys | Cys | Glu | Tyr | D-Cys | Cys | Asn | Pro | Ala | Cys | Thr | Gly | D-Cys | Lys |
| Ala | Ser | Cys | Cys | Glu | Tyr | D-Cys | Cys | Asn | Pro | Ala | Cys | Thr | Gly | D-Cys | Tyr |
| Ala | Ser | Cys | Cys | Glu | Tyr | D-Cys | Cys | Thr | Pro | Ala | Cys | Thr | Gly | Cys | — |
| Ala | Ser | Cys | Cys | Glu | Tyr | D-Cys | Cys | Thr | Pro | Ala | Cys | Thr | Gly | Cys | Lys |
| Ala | Ser | Cys | Cys | Glu | Tyr | D-Cys | Cys | Thr | Pro | Ala | Cys | Thr | Gly | Cys | Tyr |
| Ala | Ser | Cys | Cys | Glu | Tyr | D-Cys | Cys | Thr | Pro | Ala | Cys | Thr | Gly | D-Cys | — |
| Ala | Ser | Cys | Cys | Glu | Tyr | D-Cys | Cys | Thr | Pro | Ala | Cys | Thr | Gly | D-Cys | Lys |
| Ala | Ser | Cys | Cys | Glu | Tyr | D-Cys | Cys | Thr | Pro | Ala | Cys | Thr | Gly | D-Cys | Tyr |
| Ala | Ser | Cys | Cys | Glu | Phe | Cys | Cys | Asn | Pro | Ala | Cys | Thr | Gly | Cys | — |
| Ala | Ser | Cys | Cys | Glu | Phe | Cys | Cys | Asn | Pro | Ala | Cys | Thr | Gly | Cys | Lys |
| Ala | Ser | Cys | Cys | Glu | Phe | Cys | Cys | Asn | Pro | Ala | Cys | Thr | Gly | Cys | Tyr |
| Ala | Ser | Cys | Cys | Glu | Phe | Cys | Cys | Asn | Pro | Ala | Cys | Thr | Gly | D-Cys | — |
| Ala | Ser | Cys | Cys | Glu | Phe | Cys | Cys | Asn | Pro | Ala | Cys | Thr | Gly | D-Cys | Lys |
| Ala | Ser | Cys | Cys | Glu | Phe | Cys | Cys | Asn | Pro | Ala | Cys | Thr | Gly | D-Cys | Tyr |
| Ala | Ser | Cys | Cys | Glu | Phe | Cys | Cys | Thr | Pro | Ala | Cys | Thr | Gly | Cys | — |
| Ala | Ser | Cys | Cys | Glu | Phe | Cys | Cys | Thr | Pro | Ala | Cys | Thr | Gly | Cys | Lys |
| Ala | Ser | Cys | Cys | Glu | Phe | Cys | Cys | Thr | Pro | Ala | Cys | Thr | Gly | Cys | Tyr |
| Ala | Ser | Cys | Cys | Glu | Phe | Cys | Cys | Thr | Pro | Ala | Cys | Thr | Gly | D-Cys | — |
| Ala | Ser | Cys | Cys | Glu | Phe | Cys | Cys | Thr | Pro | Ala | Cys | Thr | Gly | D-Cys | Lys |
| Ala | Ser | Cys | Cys | Glu | Phe | Cys | Cys | Thr | Pro | Ala | Cys | Thr | Gly | D-Cys | Tyr |
| Ala | Ser | Cys | Cys | Glu | Phe | D-Cys | Cys | Asn | Pro | Ala | Cys | Thr | Gly | Cys | — |
| Ala | Ser | Cys | Cys | Glu | Phe | D-Cys | Cys | Asn | Pro | Ala | Cys | Thr | Gly | Cys | Lys |
| Ala | Ser | Cys | Cys | Glu | Phe | D-Cys | Cys | Asn | Pro | Ala | Cys | Thr | Gly | Cys | Tyr |
| Ala | Ser | Cys | Cys | Glu | Phe | D-Cys | Cys | Asn | Pro | Ala | Cys | Thr | Gly | D-Cys | — |
| Ala | Ser | Cys | Cys | Glu | Phe | D-Cys | Cys | Asn | Pro | Ala | Cys | Thr | Gly | D-Cys | Lys |
| Ala | Ser | Cys | Cys | Glu | Phe | D-Cys | Cys | Asn | Pro | Ala | Cys | Thr | Gly | D-Cys | Tyr |
| Ala | Ser | Cys | Cys | Glu | Phe | D-Cys | Cys | Thr | Pro | Ala | Cys | Thr | Gly | Cys | — |
| Ala | Ser | Cys | Cys | Glu | Phe | D-Cys | Cys | Thr | Pro | Ala | Cys | Thr | Gly | Cys | Lys |
| Ala | Ser | Cys | Cys | Glu | Phe | D-Cys | Cys | Thr | Pro | Ala | Cys | Thr | Gly | Cys | Tyr |
| Ala | Ser | Cys | Cys | Glu | Phe | D-Cys | Cys | Thr | Pro | Ala | Cys | Thr | Gly | D-Cys | — |
| Ala | Ser | Cys | Cys | Glu | Phe | D-Cys | Cys | Thr | Pro | Ala | Cys | Thr | Gly | D-Cys | Lys |
| Ala | Ser | Cys | Cys | Glu | Phe | D-Cys | Cys | Thr | Pro | Ala | Cys | Thr | Gly | D-Cys | Tyr |
| Ala | Ser | Cys | Cys | Glu | Trp | Cys | Cys | Asn | Pro | Ala | Cys | Thr | Gly | Cys | — |
| Ala | Ser | Cys | Cys | Glu | Trp | Cys | Cys | Asn | Pro | Ala | Cys | Thr | Gly | Cys | Lys |
| Ala | Ser | Cys | Cys | Glu | Trp | Cys | Cys | Asn | Pro | Ala | Cys | Thr | Gly | Cys | Tyr |

FIG. 3A-50

| | | | | | | | | | | | | | | |
|---|---|---|---|---|---|---|---|---|---|---|---|---|---|---|
| Ala | Ser | Cys | Cys | Glu | Trp | Cys | Cys | Asn | Pro | Ala | Cys | Thr | Gly | D-Cys | — |
| Ala | Ser | Cys | Cys | Glu | Trp | Cys | Cys | Asn | Pro | Ala | Cys | Thr | Gly | D-Cys | Lys |
| Ala | Ser | Cys | Cys | Glu | Trp | Cys | Cys | Asn | Pro | Ala | Cys | Thr | Gly | D-Cys | Tyr |
| Ala | Ser | Cys | Cys | Glu | Trp | Cys | Cys | Thr | Pro | Ala | Cys | Thr | Gly | Cys | — |
| Ala | Ser | Cys | Cys | Glu | Trp | Cys | Cys | Thr | Pro | Ala | Cys | Thr | Gly | Cys | Lys |
| Ala | Ser | Cys | Cys | Glu | Trp | Cys | Cys | Thr | Pro | Ala | Cys | Thr | Gly | Cys | Tyr |
| Ala | Ser | Cys | Cys | Glu | Trp | Cys | Cys | Thr | Pro | Ala | Cys | Thr | Gly | D-Cys | — |
| Ala | Ser | Cys | Cys | Glu | Trp | Cys | Cys | Thr | Pro | Ala | Cys | Thr | Gly | D-Cys | Lys |
| Ala | Ser | Cys | Cys | Glu | Trp | Cys | Cys | Thr | Pro | Ala | Cys | Thr | Gly | D-Cys | Tyr |
| Ala | Ser | Cys | Cys | Glu | Trp | D-Cys | Cys | Asn | Pro | Ala | Cys | Thr | Gly | Cys | — |
| Ala | Ser | Cys | Cys | Glu | Trp | D-Cys | Cys | Asn | Pro | Ala | Cys | Thr | Gly | Cys | Lys |
| Ala | Ser | Cys | Cys | Glu | Trp | D-Cys | Cys | Asn | Pro | Ala | Cys | Thr | Gly | Cys | Tyr |
| Ala | Ser | Cys | Cys | Glu | Trp | D-Cys | Cys | Asn | Pro | Ala | Cys | Thr | Gly | D-Cys | — |
| Ala | Ser | Cys | Cys | Glu | Trp | D-Cys | Cys | Asn | Pro | Ala | Cys | Thr | Gly | D-Cys | Lys |
| Ala | Ser | Cys | Cys | Glu | Trp | D-Cys | Cys | Asn | Pro | Ala | Cys | Thr | Gly | D-Cys | Tyr |
| Ala | Ser | Cys | Cys | Glu | Trp | D-Cys | Cys | Thr | Pro | Ala | Cys | Thr | Gly | Cys | — |
| Ala | Ser | Cys | Cys | Glu | Trp | D-Cys | Cys | Thr | Pro | Ala | Cys | Thr | Gly | Cys | Lys |
| Ala | Ser | Cys | Cys | Glu | Trp | D-Cys | Cys | Thr | Pro | Ala | Cys | Thr | Gly | Cys | Tyr |
| Ala | Ser | Cys | Cys | Glu | Trp | D-Cys | Cys | Thr | Pro | Ala | Cys | Thr | Gly | D-Cys | — |
| Ala | Ser | Cys | Cys | Glu | Trp | D-Cys | Cys | Thr | Pro | Ala | Cys | Thr | Gly | D-Cys | Lys |
| Ala | Ser | Cys | Cys | Glu | Trp | D-Cys | Cys | Thr | Pro | Ala | Cys | Thr | Gly | D-Cys | Tyr |
| Ala | Ser | D-Cys | Cys | Glu | Val | Cys | Cys | Asn | Pro | Ala | Cys | Thr | Gly | Cys | — |
| Ala | Ser | D-Cys | Cys | Glu | Val | Cys | Cys | Asn | Pro | Ala | Cys | Thr | Gly | Cys | Lys |
| Ala | Ser | D-Cys | Cys | Glu | Val | Cys | Cys | Asn | Pro | Ala | Cys | Thr | Gly | Cys | Tyr |
| Ala | Ser | D-Cys | Cys | Glu | Val | Cys | Cys | Asn | Pro | Ala | Cys | Thr | Gly | D-Cys | — |
| Ala | Ser | D-Cys | Cys | Glu | Val | Cys | Cys | Asn | Pro | Ala | Cys | Thr | Gly | D-Cys | Lys |
| Ala | Ser | D-Cys | Cys | Glu | Val | Cys | Cys | Asn | Pro | Ala | Cys | Thr | Gly | D-Cys | Tyr |
| Ala | Ser | D-Cys | Cys | Glu | Val | Cys | Cys | Thr | Pro | Ala | Cys | Thr | Gly | Cys | — |
| Ala | Ser | D-Cys | Cys | Glu | Val | Cys | Cys | Thr | Pro | Ala | Cys | Thr | Gly | Cys | Lys |
| Ala | Ser | D-Cys | Cys | Glu | Val | Cys | Cys | Thr | Pro | Ala | Cys | Thr | Gly | Cys | Tyr |
| Ala | Ser | D-Cys | Cys | Glu | Val | Cys | Cys | Thr | Pro | Ala | Cys | Thr | Gly | D-Cys | — |
| Ala | Ser | D-Cys | Cys | Glu | Val | Cys | Cys | Thr | Pro | Ala | Cys | Thr | Gly | D-Cys | Lys |
| Ala | Ser | D-Cys | Cys | Glu | Val | Cys | Cys | Thr | Pro | Ala | Cys | Thr | Gly | D-Cys | Tyr |
| Ala | Ser | D-Cys | Cys | Glu | Val | D-Cys | Cys | Asn | Pro | Ala | Cys | Thr | Gly | Cys | — |
| Ala | Ser | D-Cys | Cys | Glu | Val | D-Cys | Cys | Asn | Pro | Ala | Cys | Thr | Gly | Cys | Lys |
| Ala | Ser | D-Cys | Cys | Glu | Val | D-Cys | Cys | Asn | Pro | Ala | Cys | Thr | Gly | Cys | Tyr |
| Ala | Ser | D-Cys | Cys | Glu | Val | D-Cys | Cys | Asn | Pro | Ala | Cys | Thr | Gly | D-Cys | — |
| Ala | Ser | D-Cys | Cys | Glu | Val | D-Cys | Cys | Asn | Pro | Ala | Cys | Thr | Gly | D-Cys | Lys |
| Ala | Ser | D-Cys | Cys | Glu | Val | D-Cys | Cys | Asn | Pro | Ala | Cys | Thr | Gly | D-Cys | Tyr |
| Ala | Ser | D-Cys | Cys | Glu | Val | D-Cys | Cys | Thr | Pro | Ala | Cys | Thr | Gly | Cys | — |
| Ala | Ser | D-Cys | Cys | Glu | Val | D-Cys | Cys | Thr | Pro | Ala | Cys | Thr | Gly | Cys | Lys |
| Ala | Ser | D-Cys | Cys | Glu | Val | D-Cys | Cys | Thr | Pro | Ala | Cys | Thr | Gly | Cys | Tyr |
| Ala | Ser | D-Cys | Cys | Glu | Val | D-Cys | Cys | Thr | Pro | Ala | Cys | Thr | Gly | D-Cys | — |
| Ala | Ser | D-Cys | Cys | Glu | Val | D-Cys | Cys | Thr | Pro | Ala | Cys | Thr | Gly | D-Cys | Lys |
| Ala | Ser | D-Cys | Cys | Glu | Val | D-Cys | Cys | Thr | Pro | Ala | Cys | Thr | Gly | D-Cys | Tyr |
| Ala | Ser | D-Cys | Cys | Glu | Ile | Cys | Cys | Asn | Pro | Ala | Cys | Thr | Gly | Cys | — |
| Ala | Ser | D-Cys | Cys | Glu | Ile | Cys | Cys | Asn | Pro | Ala | Cys | Thr | Gly | Cys | Lys |
| Ala | Ser | D-Cys | Cys | Glu | Ile | Cys | Cys | Asn | Pro | Ala | Cys | Thr | Gly | Cys | Tyr |
| Ala | Ser | D-Cys | Cys | Glu | Ile | Cys | Cys | Asn | Pro | Ala | Cys | Thr | Gly | D-Cys | — |
| Ala | Ser | D-Cys | Cys | Glu | Ile | Cys | Cys | Asn | Pro | Ala | Cys | Thr | Gly | D-Cys | Lys |
| Ala | Ser | D-Cys | Cys | Glu | Ile | Cys | Cys | Asn | Pro | Ala | Cys | Thr | Gly | D-Cys | Tyr |
| Ala | Ser | D-Cys | Cys | Glu | Ile | Cys | Cys | Thr | Pro | Ala | Cys | Thr | Gly | Cys | — |
| Ala | Ser | D-Cys | Cys | Glu | Ile | Cys | Cys | Thr | Pro | Ala | Cys | Thr | Gly | Cys | Lys |
| Ala | Ser | D-Cys | Cys | Glu | Ile | Cys | Cys | Thr | Pro | Ala | Cys | Thr | Gly | Cys | Tyr |
| Ala | Ser | D-Cys | Cys | Glu | Ile | Cys | Cys | Thr | Pro | Ala | Cys | Thr | Gly | D-Cys | — |
| Ala | Ser | D-Cys | Cys | Glu | Ile | Cys | Cys | Thr | Pro | Ala | Cys | Thr | Gly | D-Cys | Lys |
| Ala | Ser | D-Cys | Cys | Glu | Ile | Cys | Cys | Thr | Pro | Ala | Cys | Thr | Gly | D-Cys | Tyr |
| Ala | Ser | D-Cys | Cys | Glu | Ile | D-Cys | Cys | Asn | Pro | Ala | Cys | Thr | Gly | Cys | — |
| Ala | Ser | D-Cys | Cys | Glu | Ile | D-Cys | Cys | Asn | Pro | Ala | Cys | Thr | Gly | Cys | Lys |
| Ala | Ser | D-Cys | Cys | Glu | Ile | D-Cys | Cys | Asn | Pro | Ala | Cys | Thr | Gly | Cys | Tyr |

FIG. 3A-51

| Ala | Ser | D-Cys | Cys | Glu | Ile | D-Cys | Cys | Asn | Pro | Ala | Cys | Thr | Gly | D-Cys | — |
|---|---|---|---|---|---|---|---|---|---|---|---|---|---|---|---|
| Ala | Ser | D-Cys | Cys | Glu | Ile | D-Cys | Cys | Asn | Pro | Ala | Cys | Thr | Gly | D-Cys | Lys |
| Ala | Ser | D-Cys | Cys | Glu | Ile | D-Cys | Cys | Asn | Pro | Ala | Cys | Thr | Gly | D-Cys | Tyr |
| Ala | Ser | D-Cys | Cys | Glu | Ile | D-Cys | Cys | Thr | Pro | Ala | Cys | Thr | Gly | Cys | — |
| Ala | Ser | D-Cys | Cys | Glu | Ile | D-Cys | Cys | Thr | Pro | Ala | Cys | Thr | Gly | Cys | Lys |
| Ala | Ser | D-Cys | Cys | Glu | Ile | D-Cys | Cys | Thr | Pro | Ala | Cys | Thr | Gly | Cys | Tyr |
| Ala | Ser | D-Cys | Cys | Glu | Ile | D-Cys | Cys | Thr | Pro | Ala | Cys | Thr | Gly | D-Cys | — |
| Ala | Ser | D-Cys | Cys | Glu | Ile | D-Cys | Cys | Thr | Pro | Ala | Cys | Thr | Gly | D-Cys | Lys |
| Ala | Ser | D-Cys | Cys | Glu | Ile | D-Cys | Cys | Thr | Pro | Ala | Cys | Thr | Gly | D-Cys | Tyr |
| Ala | Ser | D-Cys | Cys | Glu | Leu | Cys | Cys | Asn | Pro | Ala | Cys | Thr | Gly | Cys | — |
| Ala | Ser | D-Cys | Cys | Glu | Leu | Cys | Cys | Asn | Pro | Ala | Cys | Thr | Gly | Cys | Lys |
| Ala | Ser | D-Cys | Cys | Glu | Leu | Cys | Cys | Asn | Pro | Ala | Cys | Thr | Gly | Cys | Tyr |
| Ala | Ser | D-Cys | Cys | Glu | Leu | Cys | Cys | Asn | Pro | Ala | Cys | Thr | Gly | D-Cys | — |
| Ala | Ser | D-Cys | Cys | Glu | Leu | Cys | Cys | Asn | Pro | Ala | Cys | Thr | Gly | D-Cys | Lys |
| Ala | Ser | D-Cys | Cys | Glu | Leu | Cys | Cys | Asn | Pro | Ala | Cys | Thr | Gly | D-Cys | Tyr |
| Ala | Ser | D-Cys | Cys | Glu | Leu | Cys | Cys | Thr | Pro | Ala | Cys | Thr | Gly | Cys | — |
| Ala | Ser | D-Cys | Cys | Glu | Leu | Cys | Cys | Thr | Pro | Ala | Cys | Thr | Gly | Cys | Lys |
| Ala | Ser | D-Cys | Cys | Glu | Leu | Cys | Cys | Thr | Pro | Ala | Cys | Thr | Gly | Cys | Tyr |
| Ala | Ser | D-Cys | Cys | Glu | Leu | Cys | Cys | Thr | Pro | Ala | Cys | Thr | Gly | D-Cys | — |
| Ala | Ser | D-Cys | Cys | Glu | Leu | Cys | Cys | Thr | Pro | Ala | Cys | Thr | Gly | D-Cys | Lys |
| Ala | Ser | D-Cys | Cys | Glu | Leu | Cys | Cys | Thr | Pro | Ala | Cys | Thr | Gly | D-Cys | Tyr |
| Ala | Ser | D-Cys | Cys | Glu | Leu | D-Cys | Cys | Asn | Pro | Ala | Cys | Thr | Gly | Cys | — |
| Ala | Ser | D-Cys | Cys | Glu | Leu | D-Cys | Cys | Asn | Pro | Ala | Cys | Thr | Gly | Cys | Lys |
| Ala | Ser | D-Cys | Cys | Glu | Leu | D-Cys | Cys | Asn | Pro | Ala | Cys | Thr | Gly | Cys | Tyr |
| Ala | Ser | D-Cys | Cys | Glu | Leu | D-Cys | Cys | Asn | Pro | Ala | Cys | Thr | Gly | D-Cys | — |
| Ala | Ser | D-Cys | Cys | Glu | Leu | D-Cys | Cys | Asn | Pro | Ala | Cys | Thr | Gly | D-Cys | Lys |
| Ala | Ser | D-Cys | Cys | Glu | Leu | D-Cys | Cys | Asn | Pro | Ala | Cys | Thr | Gly | D-Cys | Tyr |
| Ala | Ser | D-Cys | Cys | Glu | Leu | D-Cys | Cys | Thr | Pro | Ala | Cys | Thr | Gly | Cys | — |
| Ala | Ser | D-Cys | Cys | Glu | Leu | D-Cys | Cys | Thr | Pro | Ala | Cys | Thr | Gly | Cys | Lys |
| Ala | Ser | D-Cys | Cys | Glu | Leu | D-Cys | Cys | Thr | Pro | Ala | Cys | Thr | Gly | Cys | Tyr |
| Ala | Ser | D-Cys | Cys | Glu | Leu | D-Cys | Cys | Thr | Pro | Ala | Cys | Thr | Gly | D-Cys | — |
| Ala | Ser | D-Cys | Cys | Glu | Leu | D-Cys | Cys | Thr | Pro | Ala | Cys | Thr | Gly | D-Cys | Lys |
| Ala | Ser | D-Cys | Cys | Glu | Leu | D-Cys | Cys | Thr | Pro | Ala | Cys | Thr | Gly | D-Cys | Tyr |
| Ala | Ser | D-Cys | Cys | Glu | Tyr | Cys | Cys | Asn | Pro | Ala | Cys | Thr | Gly | Cys | — |
| Ala | Ser | D-Cys | Cys | Glu | Tyr | Cys | Cys | Asn | Pro | Ala | Cys | Thr | Gly | Cys | Lys |
| Ala | Ser | D-Cys | Cys | Glu | Tyr | Cys | Cys | Asn | Pro | Ala | Cys | Thr | Gly | Cys | Tyr |
| Ala | Ser | D-Cys | Cys | Glu | Tyr | Cys | Cys | Asn | Pro | Ala | Cys | Thr | Gly | D-Cys | — |
| Ala | Ser | D-Cys | Cys | Glu | Tyr | Cys | Cys | Asn | Pro | Ala | Cys | Thr | Gly | D-Cys | Lys |
| Ala | Ser | D-Cys | Cys | Glu | Tyr | Cys | Cys | Asn | Pro | Ala | Cys | Thr | Gly | D-Cys | Tyr |
| Ala | Ser | D-Cys | Cys | Glu | Tyr | Cys | Cys | Thr | Pro | Ala | Cys | Thr | Gly | Cys | — |
| Ala | Ser | D-Cys | Cys | Glu | Tyr | Cys | Cys | Thr | Pro | Ala | Cys | Thr | Gly | Cys | Lys |
| Ala | Ser | D-Cys | Cys | Glu | Tyr | Cys | Cys | Thr | Pro | Ala | Cys | Thr | Gly | Cys | Tyr |
| Ala | Ser | D-Cys | Cys | Glu | Tyr | Cys | Cys | Thr | Pro | Ala | Cys | Thr | Gly | D-Cys | — |
| Ala | Ser | D-Cys | Cys | Glu | Tyr | Cys | Cys | Thr | Pro | Ala | Cys | Thr | Gly | D-Cys | Lys |
| Ala | Ser | D-Cys | Cys | Glu | Tyr | Cys | Cys | Thr | Pro | Ala | Cys | Thr | Gly | D-Cys | Tyr |
| Ala | Ser | D-Cys | Cys | Glu | Tyr | D-Cys | Cys | Asn | Pro | Ala | Cys | Thr | Gly | Cys | — |
| Ala | Ser | D-Cys | Cys | Glu | Tyr | D-Cys | Cys | Asn | Pro | Ala | Cys | Thr | Gly | Cys | Lys |
| Ala | Ser | D-Cys | Cys | Glu | Tyr | D-Cys | Cys | Asn | Pro | Ala | Cys | Thr | Gly | Cys | Tyr |
| Ala | Ser | D-Cys | Cys | Glu | Tyr | D-Cys | Cys | Asn | Pro | Ala | Cys | Thr | Gly | D-Cys | — |
| Ala | Ser | D-Cys | Cys | Glu | Tyr | D-Cys | Cys | Asn | Pro | Ala | Cys | Thr | Gly | D-Cys | Lys |
| Ala | Ser | D-Cys | Cys | Glu | Tyr | D-Cys | Cys | Asn | Pro | Ala | Cys | Thr | Gly | D-Cys | Tyr |
| Ala | Ser | D-Cys | Cys | Glu | Tyr | D-Cys | Cys | Thr | Pro | Ala | Cys | Thr | Gly | Cys | — |
| Ala | Ser | D-Cys | Cys | Glu | Tyr | D-Cys | Cys | Thr | Pro | Ala | Cys | Thr | Gly | Cys | Lys |
| Ala | Ser | D-Cys | Cys | Glu | Tyr | D-Cys | Cys | Thr | Pro | Ala | Cys | Thr | Gly | Cys | Tyr |
| Ala | Ser | D-Cys | Cys | Glu | Tyr | D-Cys | Cys | Thr | Pro | Ala | Cys | Thr | Gly | D-Cys | — |
| Ala | Ser | D-Cys | Cys | Glu | Tyr | D-Cys | Cys | Thr | Pro | Ala | Cys | Thr | Gly | D-Cys | Lys |
| Ala | Ser | D-Cys | Cys | Glu | Tyr | D-Cys | Cys | Thr | Pro | Ala | Cys | Thr | Gly | D-Cys | Tyr |
| Ala | Ser | D-Cys | Cys | Glu | Phe | Cys | Cys | Asn | Pro | Ala | Cys | Thr | Gly | Cys | — |
| Ala | Ser | D-Cys | Cys | Glu | Phe | Cys | Cys | Asn | Pro | Ala | Cys | Thr | Gly | Cys | Lys |
| Ala | Ser | D-Cys | Cys | Glu | Phe | Cys | Cys | Asn | Pro | Ala | Cys | Thr | Gly | Cys | Tyr |

FIG. 3A-52

| Ala | Ser | D-Cys | Cys | Glu | Phe | Cys | Cys | Asn | Pro | Ala | Cys | Thr | Gly | D-Cys | — |
|---|---|---|---|---|---|---|---|---|---|---|---|---|---|---|---|
| Ala | Ser | D-Cys | Cys | Glu | Phe | Cys | Cys | Asn | Pro | Ala | Cys | Thr | Gly | D-Cys | Lys |
| Ala | Ser | D-Cys | Cys | Glu | Phe | Cys | Cys | Asn | Pro | Ala | Cys | Thr | Gly | D-Cys | Tyr |
| Ala | Ser | D-Cys | Cys | Glu | Phe | Cys | Cys | Thr | Pro | Ala | Cys | Thr | Gly | Cys | — |
| Ala | Ser | D-Cys | Cys | Glu | Phe | Cys | Cys | Thr | Pro | Ala | Cys | Thr | Gly | Cys | Lys |
| Ala | Ser | D-Cys | Cys | Glu | Phe | Cys | Cys | Thr | Pro | Ala | Cys | Thr | Gly | Cys | Tyr |
| Ala | Ser | D-Cys | Cys | Glu | Phe | Cys | Cys | Thr | Pro | Ala | Cys | Thr | Gly | D-Cys | — |
| Ala | Ser | D-Cys | Cys | Glu | Phe | Cys | Cys | Thr | Pro | Ala | Cys | Thr | Gly | D-Cys | Lys |
| Ala | Ser | D-Cys | Cys | Glu | Phe | Cys | Cys | Thr | Pro | Ala | Cys | Thr | Gly | D-Cys | Tyr |
| Ala | Ser | D-Cys | Cys | Glu | Phe | D-Cys | Cys | Asn | Pro | Ala | Cys | Thr | Gly | Cys | — |
| Ala | Ser | D-Cys | Cys | Glu | Phe | D-Cys | Cys | Asn | Pro | Ala | Cys | Thr | Gly | Cys | Lys |
| Ala | Ser | D-Cys | Cys | Glu | Phe | D-Cys | Cys | Asn | Pro | Ala | Cys | Thr | Gly | Cys | Tyr |
| Ala | Ser | D-Cys | Cys | Glu | Phe | D-Cys | Cys | Asn | Pro | Ala | Cys | Thr | Gly | D-Cys | — |
| Ala | Ser | D-Cys | Cys | Glu | Phe | D-Cys | Cys | Asn | Pro | Ala | Cys | Thr | Gly | D-Cys | Lys |
| Ala | Ser | D-Cys | Cys | Glu | Phe | D-Cys | Cys | Asn | Pro | Ala | Cys | Thr | Gly | D-Cys | Tyr |
| Ala | Ser | D-Cys | Cys | Glu | Phe | D-Cys | Cys | Thr | Pro | Ala | Cys | Thr | Gly | Cys | — |
| Ala | Ser | D-Cys | Cys | Glu | Phe | D-Cys | Cys | Thr | Pro | Ala | Cys | Thr | Gly | Cys | Lys |
| Ala | Ser | D-Cys | Cys | Glu | Phe | D-Cys | Cys | Thr | Pro | Ala | Cys | Thr | Gly | Cys | Tyr |
| Ala | Ser | D-Cys | Cys | Glu | Phe | D-Cys | Cys | Thr | Pro | Ala | Cys | Thr | Gly | D-Cys | — |
| Ala | Ser | D-Cys | Cys | Glu | Phe | D-Cys | Cys | Thr | Pro | Ala | Cys | Thr | Gly | D-Cys | Lys |
| Ala | Ser | D-Cys | Cys | Glu | Phe | D-Cys | Cys | Thr | Pro | Ala | Cys | Thr | Gly | D-Cys | Tyr |
| Ala | Ser | D-Cys | Cys | Glu | Trp | Cys | Cys | Asn | Pro | Ala | Cys | Thr | Gly | Cys | — |
| Ala | Ser | D-Cys | Cys | Glu | Trp | Cys | Cys | Asn | Pro | Ala | Cys | Thr | Gly | Cys | Lys |
| Ala | Ser | D-Cys | Cys | Glu | Trp | Cys | Cys | Asn | Pro | Ala | Cys | Thr | Gly | Cys | Tyr |
| Ala | Ser | D-Cys | Cys | Glu | Trp | Cys | Cys | Asn | Pro | Ala | Cys | Thr | Gly | D-Cys | — |
| Ala | Ser | D-Cys | Cys | Glu | Trp | Cys | Cys | Asn | Pro | Ala | Cys | Thr | Gly | D-Cys | Lys |
| Ala | Ser | D-Cys | Cys | Glu | Trp | Cys | Cys | Asn | Pro | Ala | Cys | Thr | Gly | D-Cys | Tyr |
| Ala | Ser | D-Cys | Cys | Glu | Trp | Cys | Cys | Thr | Pro | Ala | Cys | Thr | Gly | Cys | — |
| Ala | Ser | D-Cys | Cys | Glu | Trp | Cys | Cys | Thr | Pro | Ala | Cys | Thr | Gly | Cys | Lys |
| Ala | Ser | D-Cys | Cys | Glu | Trp | Cys | Cys | Thr | Pro | Ala | Cys | Thr | Gly | Cys | Tyr |
| Ala | Ser | D-Cys | Cys | Glu | Trp | Cys | Cys | Thr | Pro | Ala | Cys | Thr | Gly | D-Cys | — |
| Ala | Ser | D-Cys | Cys | Glu | Trp | Cys | Cys | Thr | Pro | Ala | Cys | Thr | Gly | D-Cys | Lys |
| Ala | Ser | D-Cys | Cys | Glu | Trp | Cys | Cys | Thr | Pro | Ala | Cys | Thr | Gly | D-Cys | Tyr |
| Ala | Ser | D-Cys | Cys | Glu | Trp | D-Cys | Cys | Asn | Pro | Ala | Cys | Thr | Gly | Cys | — |
| Ala | Ser | D-Cys | Cys | Glu | Trp | D-Cys | Cys | Asn | Pro | Ala | Cys | Thr | Gly | Cys | Lys |
| Ala | Ser | D-Cys | Cys | Glu | Trp | D-Cys | Cys | Asn | Pro | Ala | Cys | Thr | Gly | Cys | Tyr |
| Ala | Ser | D-Cys | Cys | Glu | Trp | D-Cys | Cys | Asn | Pro | Ala | Cys | Thr | Gly | D-Cys | — |
| Ala | Ser | D-Cys | Cys | Glu | Trp | D-Cys | Cys | Asn | Pro | Ala | Cys | Thr | Gly | D-Cys | Lys |
| Ala | Ser | D-Cys | Cys | Glu | Trp | D-Cys | Cys | Asn | Pro | Ala | Cys | Thr | Gly | D-Cys | Tyr |
| Ala | Ser | D-Cys | Cys | Glu | Trp | D-Cys | Cys | Thr | Pro | Ala | Cys | Thr | Gly | Cys | — |
| Ala | Ser | D-Cys | Cys | Glu | Trp | D-Cys | Cys | Thr | Pro | Ala | Cys | Thr | Gly | Cys | Lys |
| Ala | Ser | D-Cys | Cys | Glu | Trp | D-Cys | Cys | Thr | Pro | Ala | Cys | Thr | Gly | Cys | Tyr |
| Ala | Ser | D-Cys | Cys | Glu | Trp | D-Cys | Cys | Thr | Pro | Ala | Cys | Thr | Gly | D-Cys | — |
| Ala | Ser | D-Cys | Cys | Glu | Trp | D-Cys | Cys | Thr | Pro | Ala | Cys | Thr | Gly | D-Cys | Lys |
| Ala | Ser | D-Cys | Cys | Glu | Trp | D-Cys | Cys | Thr | Pro | Ala | Cys | Thr | Gly | D-Cys | Tyr |
| Ala | Val | Cys | Cys | Glu | Val | Cys | Cys | Asn | Pro | Ala | Cys | Thr | Gly | Cys | — |
| Ala | Val | Cys | Cys | Glu | Val | Cys | Cys | Asn | Pro | Ala | Cys | Thr | Gly | Cys | Lys |
| Ala | Val | Cys | Cys | Glu | Val | Cys | Cys | Asn | Pro | Ala | Cys | Thr | Gly | Cys | Tyr |
| Ala | Val | Cys | Cys | Glu | Val | Cys | Cys | Asn | Pro | Ala | Cys | Thr | Gly | D-Cys | — |
| Ala | Val | Cys | Cys | Glu | Val | Cys | Cys | Asn | Pro | Ala | Cys | Thr | Gly | D-Cys | Lys |
| Ala | Val | Cys | Cys | Glu | Val | Cys | Cys | Asn | Pro | Ala | Cys | Thr | Gly | D-Cys | Tyr |
| Ala | Val | Cys | Cys | Glu | Val | Cys | Cys | Thr | Pro | Ala | Cys | Thr | Gly | Cys | — |
| Ala | Val | Cys | Cys | Glu | Val | Cys | Cys | Thr | Pro | Ala | Cys | Thr | Gly | Cys | Lys |
| Ala | Val | Cys | Cys | Glu | Val | Cys | Cys | Thr | Pro | Ala | Cys | Thr | Gly | Cys | Tyr |
| Ala | Val | Cys | Cys | Glu | Val | Cys | Cys | Thr | Pro | Ala | Cys | Thr | Gly | D-Cys | — |
| Ala | Val | Cys | Cys | Glu | Val | Cys | Cys | Thr | Pro | Ala | Cys | Thr | Gly | D-Cys | Lys |
| Ala | Val | Cys | Cys | Glu | Val | Cys | Cys | Thr | Pro | Ala | Cys | Thr | Gly | D-Cys | Tyr |
| Ala | Val | Cys | Cys | Glu | Val | D-Cys | Cys | Asn | Pro | Ala | Cys | Thr | Gly | Cys | — |
| Ala | Val | Cys | Cys | Glu | Val | D-Cys | Cys | Asn | Pro | Ala | Cys | Thr | Gly | Cys | Lys |
| Ala | Val | Cys | Cys | Glu | Val | D-Cys | Cys | Asn | Pro | Ala | Cys | Thr | Gly | Cys | Tyr |

FIG. 3A-53

| | | | | | | | | | | | | | | |
|---|---|---|---|---|---|---|---|---|---|---|---|---|---|---|
| Ala | Val | Cys | Cys | Glu | Val | D-Cys | Cys | Asn | Pro | Ala | Cys | Thr | Gly | D-Cys | — |
| Ala | Val | Cys | Cys | Glu | Val | D-Cys | Cys | Asn | Pro | Ala | Cys | Thr | Gly | D-Cys | Lys |
| Ala | Val | Cys | Cys | Glu | Val | D-Cys | Cys | Asn | Pro | Ala | Cys | Thr | Gly | D-Cys | Tyr |
| Ala | Val | Cys | Cys | Glu | Val | D-Cys | Cys | Thr | Pro | Ala | Cys | Thr | Gly | Cys | — |
| Ala | Val | Cys | Cys | Glu | Val | D-Cys | Cys | Thr | Pro | Ala | Cys | Thr | Gly | Cys | Lys |
| Ala | Val | Cys | Cys | Glu | Val | D-Cys | Cys | Thr | Pro | Ala | Cys | Thr | Gly | Cys | Tyr |
| Ala | Val | Cys | Cys | Glu | Val | D-Cys | Cys | Thr | Pro | Ala | Cys | Thr | Gly | D-Cys | — |
| Ala | Val | Cys | Cys | Glu | Val | D-Cys | Cys | Thr | Pro | Ala | Cys | Thr | Gly | D-Cys | Lys |
| Ala | Val | Cys | Cys | Glu | Val | D-Cys | Cys | Thr | Pro | Ala | Cys | Thr | Gly | D-Cys | Tyr |
| Ala | Val | Cys | Cys | Glu | Ile | Cys | Cys | Asn | Pro | Ala | Cys | Thr | Gly | Cys | — |
| Ala | Val | Cys | Cys | Glu | Ile | Cys | Cys | Asn | Pro | Ala | Cys | Thr | Gly | Cys | Lys |
| Ala | Val | Cys | Cys | Glu | Ile | Cys | Cys | Asn | Pro | Ala | Cys | Thr | Gly | Cys | Tyr |
| Ala | Val | Cys | Cys | Glu | Ile | Cys | Cys | Asn | Pro | Ala | Cys | Thr | Gly | D-Cys | — |
| Ala | Val | Cys | Cys | Glu | Ile | Cys | Cys | Asn | Pro | Ala | Cys | Thr | Gly | D-Cys | Lys |
| Ala | Val | Cys | Cys | Glu | Ile | Cys | Cys | Asn | Pro | Ala | Cys | Thr | Gly | D-Cys | Tyr |
| Ala | Val | Cys | Cys | Glu | Ile | Cys | Cys | Thr | Pro | Ala | Cys | Thr | Gly | Cys | — |
| Ala | Val | Cys | Cys | Glu | Ile | Cys | Cys | Thr | Pro | Ala | Cys | Thr | Gly | Cys | Lys |
| Ala | Val | Cys | Cys | Glu | Ile | Cys | Cys | Thr | Pro | Ala | Cys | Thr | Gly | Cys | Tyr |
| Ala | Val | Cys | Cys | Glu | Ile | Cys | Cys | Thr | Pro | Ala | Cys | Thr | Gly | D-Cys | — |
| Ala | Val | Cys | Cys | Glu | Ile | Cys | Cys | Thr | Pro | Ala | Cys | Thr | Gly | D-Cys | Lys |
| Ala | Val | Cys | Cys | Glu | Ile | Cys | Cys | Thr | Pro | Ala | Cys | Thr | Gly | D-Cys | Tyr |
| Ala | Val | Cys | Cys | Glu | Ile | D-Cys | Cys | Asn | Pro | Ala | Cys | Thr | Gly | Cys | — |
| Ala | Val | Cys | Cys | Glu | Ile | D-Cys | Cys | Asn | Pro | Ala | Cys | Thr | Gly | Cys | Lys |
| Ala | Val | Cys | Cys | Glu | Ile | D-Cys | Cys | Asn | Pro | Ala | Cys | Thr | Gly | Cys | Tyr |
| Ala | Val | Cys | Cys | Glu | Ile | D-Cys | Cys | Asn | Pro | Ala | Cys | Thr | Gly | D-Cys | — |
| Ala | Val | Cys | Cys | Glu | Ile | D-Cys | Cys | Asn | Pro | Ala | Cys | Thr | Gly | D-Cys | Lys |
| Ala | Val | Cys | Cys | Glu | Ile | D-Cys | Cys | Asn | Pro | Ala | Cys | Thr | Gly | D-Cys | Tyr |
| Ala | Val | Cys | Cys | Glu | Ile | D-Cys | Cys | Thr | Pro | Ala | Cys | Thr | Gly | Cys | — |
| Ala | Val | Cys | Cys | Glu | Ile | D-Cys | Cys | Thr | Pro | Ala | Cys | Thr | Gly | Cys | Lys |
| Ala | Val | Cys | Cys | Glu | Ile | D-Cys | Cys | Thr | Pro | Ala | Cys | Thr | Gly | Cys | Tyr |
| Ala | Val | Cys | Cys | Glu | Ile | D-Cys | Cys | Thr | Pro | Ala | Cys | Thr | Gly | D-Cys | — |
| Ala | Val | Cys | Cys | Glu | Ile | D-Cys | Cys | Thr | Pro | Ala | Cys | Thr | Gly | D-Cys | Lys |
| Ala | Val | Cys | Cys | Glu | Ile | D-Cys | Cys | Thr | Pro | Ala | Cys | Thr | Gly | D-Cys | Tyr |
| Ala | Val | Cys | Cys | Glu | Leu | Cys | Cys | Asn | Pro | Ala | Cys | Thr | Gly | Cys | — |
| Ala | Val | Cys | Cys | Glu | Leu | Cys | Cys | Asn | Pro | Ala | Cys | Thr | Gly | Cys | Lys |
| Ala | Val | Cys | Cys | Glu | Leu | Cys | Cys | Asn | Pro | Ala | Cys | Thr | Gly | Cys | Tyr |
| Ala | Val | Cys | Cys | Glu | Leu | Cys | Cys | Asn | Pro | Ala | Cys | Thr | Gly | D-Cys | — |
| Ala | Val | Cys | Cys | Glu | Leu | Cys | Cys | Asn | Pro | Ala | Cys | Thr | Gly | D-Cys | Lys |
| Ala | Val | Cys | Cys | Glu | Leu | Cys | Cys | Asn | Pro | Ala | Cys | Thr | Gly | D-Cys | Tyr |
| Ala | Val | Cys | Cys | Glu | Leu | Cys | Cys | Thr | Pro | Ala | Cys | Thr | Gly | Cys | — |
| Ala | Val | Cys | Cys | Glu | Leu | Cys | Cys | Thr | Pro | Ala | Cys | Thr | Gly | Cys | Lys |
| Ala | Val | Cys | Cys | Glu | Leu | Cys | Cys | Thr | Pro | Ala | Cys | Thr | Gly | Cys | Tyr |
| Ala | Val | Cys | Cys | Glu | Leu | Cys | Cys | Thr | Pro | Ala | Cys | Thr | Gly | D-Cys | — |
| Ala | Val | Cys | Cys | Glu | Leu | Cys | Cys | Thr | Pro | Ala | Cys | Thr | Gly | D-Cys | Lys |
| Ala | Val | Cys | Cys | Glu | Leu | Cys | Cys | Thr | Pro | Ala | Cys | Thr | Gly | D-Cys | Tyr |
| Ala | Val | Cys | Cys | Glu | Leu | D-Cys | Cys | Asn | Pro | Ala | Cys | Thr | Gly | Cys | — |
| Ala | Val | Cys | Cys | Glu | Leu | D-Cys | Cys | Asn | Pro | Ala | Cys | Thr | Gly | Cys | Lys |
| Ala | Val | Cys | Cys | Glu | Leu | D-Cys | Cys | Asn | Pro | Ala | Cys | Thr | Gly | Cys | Tyr |
| Ala | Val | Cys | Cys | Glu | Leu | D-Cys | Cys | Asn | Pro | Ala | Cys | Thr | Gly | D-Cys | — |
| Ala | Val | Cys | Cys | Glu | Leu | D-Cys | Cys | Asn | Pro | Ala | Cys | Thr | Gly | D-Cys | Lys |
| Ala | Val | Cys | Cys | Glu | Leu | D-Cys | Cys | Asn | Pro | Ala | Cys | Thr | Gly | D-Cys | Tyr |
| Ala | Val | Cys | Cys | Glu | Leu | D-Cys | Cys | Thr | Pro | Ala | Cys | Thr | Gly | Cys | — |
| Ala | Val | Cys | Cys | Glu | Leu | D-Cys | Cys | Thr | Pro | Ala | Cys | Thr | Gly | Cys | Lys |
| Ala | Val | Cys | Cys | Glu | Leu | D-Cys | Cys | Thr | Pro | Ala | Cys | Thr | Gly | Cys | Tyr |
| Ala | Val | Cys | Cys | Glu | Leu | D-Cys | Cys | Thr | Pro | Ala | Cys | Thr | Gly | D-Cys | — |
| Ala | Val | Cys | Cys | Glu | Leu | D-Cys | Cys | Thr | Pro | Ala | Cys | Thr | Gly | D-Cys | Lys |
| Ala | Val | Cys | Cys | Glu | Leu | D-Cys | Cys | Thr | Pro | Ala | Cys | Thr | Gly | D-Cys | Tyr |
| Ala | Val | Cys | Cys | Glu | Tyr | Cys | Cys | Asn | Pro | Ala | Cys | Thr | Gly | Cys | — |
| Ala | Val | Cys | Cys | Glu | Tyr | Cys | Cys | Asn | Pro | Ala | Cys | Thr | Gly | Cys | Lys |
| Ala | Val | Cys | Cys | Glu | Tyr | Cys | Cys | Asn | Pro | Ala | Cys | Thr | Gly | Cys | Tyr |

FIG. 3A-54

| | | | | | | | | | | | | | | |
|---|---|---|---|---|---|---|---|---|---|---|---|---|---|---|
| Ala | Val | Cys | Cys | Glu | Tyr | Cys | Cys | Asn | Pro | Ala | Cys | Thr | Gly | D-Cys | — |
| Ala | Val | Cys | Cys | Glu | Tyr | Cys | Cys | Asn | Pro | Ala | Cys | Thr | Gly | D-Cys | Lys |
| Ala | Val | Cys | Cys | Glu | Tyr | Cys | Cys | Asn | Pro | Ala | Cys | Thr | Gly | D-Cys | Tyr |
| Ala | Val | Cys | Cys | Glu | Tyr | Cys | Cys | Thr | Pro | Ala | Cys | Thr | Gly | Cys | — |
| Ala | Val | Cys | Cys | Glu | Tyr | Cys | Cys | Thr | Pro | Ala | Cys | Thr | Gly | Cys | Lys |
| Ala | Val | Cys | Cys | Glu | Tyr | Cys | Cys | Thr | Pro | Ala | Cys | Thr | Gly | Cys | Tyr |
| Ala | Val | Cys | Cys | Glu | Tyr | Cys | Cys | Thr | Pro | Ala | Cys | Thr | Gly | D-Cys | — |
| Ala | Val | Cys | Cys | Glu | Tyr | Cys | Cys | Thr | Pro | Ala | Cys | Thr | Gly | D-Cys | Lys |
| Ala | Val | Cys | Cys | Glu | Tyr | Cys | Cys | Thr | Pro | Ala | Cys | Thr | Gly | D-Cys | Tyr |
| Ala | Val | Cys | Cys | Glu | Tyr | D-Cys | Cys | Asn | Pro | Ala | Cys | Thr | Gly | Cys | — |
| Ala | Val | Cys | Cys | Glu | Tyr | D-Cys | Cys | Asn | Pro | Ala | Cys | Thr | Gly | Cys | Lys |
| Ala | Val | Cys | Cys | Glu | Tyr | D-Cys | Cys | Asn | Pro | Ala | Cys | Thr | Gly | Cys | Tyr |
| Ala | Val | Cys | Cys | Glu | Tyr | D-Cys | Cys | Asn | Pro | Ala | Cys | Thr | Gly | D-Cys | — |
| Ala | Val | Cys | Cys | Glu | Tyr | D-Cys | Cys | Asn | Pro | Ala | Cys | Thr | Gly | D-Cys | Lys |
| Ala | Val | Cys | Cys | Glu | Tyr | D-Cys | Cys | Asn | Pro | Ala | Cys | Thr | Gly | D-Cys | Tyr |
| Ala | Val | Cys | Cys | Glu | Tyr | D-Cys | Cys | Thr | Pro | Ala | Cys | Thr | Gly | Cys | — |
| Ala | Val | Cys | Cys | Glu | Tyr | D-Cys | Cys | Thr | Pro | Ala | Cys | Thr | Gly | Cys | Lys |
| Ala | Val | Cys | Cys | Glu | Tyr | D-Cys | Cys | Thr | Pro | Ala | Cys | Thr | Gly | Cys | Tyr |
| Ala | Val | Cys | Cys | Glu | Tyr | D-Cys | Cys | Thr | Pro | Ala | Cys | Thr | Gly | D-Cys | — |
| Ala | Val | Cys | Cys | Glu | Tyr | D-Cys | Cys | Thr | Pro | Ala | Cys | Thr | Gly | D-Cys | Lys |
| Ala | Val | Cys | Cys | Glu | Tyr | D-Cys | Cys | Thr | Pro | Ala | Cys | Thr | Gly | D-Cys | Tyr |
| Ala | Val | Cys | Cys | Glu | Phe | Cys | Cys | Asn | Pro | Ala | Cys | Thr | Gly | Cys | — |
| Ala | Val | Cys | Cys | Glu | Phe | Cys | Cys | Asn | Pro | Ala | Cys | Thr | Gly | Cys | Lys |
| Ala | Val | Cys | Cys | Glu | Phe | Cys | Cys | Asn | Pro | Ala | Cys | Thr | Gly | Cys | Tyr |
| Ala | Val | Cys | Cys | Glu | Phe | Cys | Cys | Asn | Pro | Ala | Cys | Thr | Gly | D-Cys | — |
| Ala | Val | Cys | Cys | Glu | Phe | Cys | Cys | Asn | Pro | Ala | Cys | Thr | Gly | D-Cys | Lys |
| Ala | Val | Cys | Cys | Glu | Phe | Cys | Cys | Asn | Pro | Ala | Cys | Thr | Gly | D-Cys | Tyr |
| Ala | Val | Cys | Cys | Glu | Phe | Cys | Cys | Thr | Pro | Ala | Cys | Thr | Gly | Cys | — |
| Ala | Val | Cys | Cys | Glu | Phe | Cys | Cys | Thr | Pro | Ala | Cys | Thr | Gly | Cys | Lys |
| Ala | Val | Cys | Cys | Glu | Phe | Cys | Cys | Thr | Pro | Ala | Cys | Thr | Gly | Cys | Tyr |
| Ala | Val | Cys | Cys | Glu | Phe | Cys | Cys | Thr | Pro | Ala | Cys | Thr | Gly | D-Cys | — |
| Ala | Val | Cys | Cys | Glu | Phe | Cys | Cys | Thr | Pro | Ala | Cys | Thr | Gly | D-Cys | Lys |
| Ala | Val | Cys | Cys | Glu | Phe | Cys | Cys | Thr | Pro | Ala | Cys | Thr | Gly | D-Cys | Tyr |
| Ala | Val | Cys | Cys | Glu | Phe | D-Cys | Cys | Asn | Pro | Ala | Cys | Thr | Gly | Cys | — |
| Ala | Val | Cys | Cys | Glu | Phe | D-Cys | Cys | Asn | Pro | Ala | Cys | Thr | Gly | Cys | Lys |
| Ala | Val | Cys | Cys | Glu | Phe | D-Cys | Cys | Asn | Pro | Ala | Cys | Thr | Gly | Cys | Tyr |
| Ala | Val | Cys | Cys | Glu | Phe | D-Cys | Cys | Asn | Pro | Ala | Cys | Thr | Gly | D-Cys | — |
| Ala | Val | Cys | Cys | Glu | Phe | D-Cys | Cys | Asn | Pro | Ala | Cys | Thr | Gly | D-Cys | Lys |
| Ala | Val | Cys | Cys | Glu | Phe | D-Cys | Cys | Asn | Pro | Ala | Cys | Thr | Gly | D-Cys | Tyr |
| Ala | Val | Cys | Cys | Glu | Phe | D-Cys | Cys | Thr | Pro | Ala | Cys | Thr | Gly | Cys | — |
| Ala | Val | Cys | Cys | Glu | Phe | D-Cys | Cys | Thr | Pro | Ala | Cys | Thr | Gly | Cys | Lys |
| Ala | Val | Cys | Cys | Glu | Phe | D-Cys | Cys | Thr | Pro | Ala | Cys | Thr | Gly | Cys | Tyr |
| Ala | Val | Cys | Cys | Glu | Phe | D-Cys | Cys | Thr | Pro | Ala | Cys | Thr | Gly | D-Cys | — |
| Ala | Val | Cys | Cys | Glu | Phe | D-Cys | Cys | Thr | Pro | Ala | Cys | Thr | Gly | D-Cys | Lys |
| Ala | Val | Cys | Cys | Glu | Phe | D-Cys | Cys | Thr | Pro | Ala | Cys | Thr | Gly | D-Cys | Tyr |
| Ala | Val | Cys | Cys | Glu | Trp | Cys | Cys | Asn | Pro | Ala | Cys | Thr | Gly | Cys | — |
| Ala | Val | Cys | Cys | Glu | Trp | Cys | Cys | Asn | Pro | Ala | Cys | Thr | Gly | Cys | Lys |
| Ala | Val | Cys | Cys | Glu | Trp | Cys | Cys | Asn | Pro | Ala | Cys | Thr | Gly | Cys | Tyr |
| Ala | Val | Cys | Cys | Glu | Trp | Cys | Cys | Asn | Pro | Ala | Cys | Thr | Gly | D-Cys | — |
| Ala | Val | Cys | Cys | Glu | Trp | Cys | Cys | Asn | Pro | Ala | Cys | Thr | Gly | D-Cys | Lys |
| Ala | Val | Cys | Cys | Glu | Trp | Cys | Cys | Asn | Pro | Ala | Cys | Thr | Gly | D-Cys | Tyr |
| Ala | Val | Cys | Cys | Glu | Trp | Cys | Cys | Thr | Pro | Ala | Cys | Thr | Gly | Cys | — |
| Ala | Val | Cys | Cys | Glu | Trp | Cys | Cys | Thr | Pro | Ala | Cys | Thr | Gly | Cys | Lys |
| Ala | Val | Cys | Cys | Glu | Trp | Cys | Cys | Thr | Pro | Ala | Cys | Thr | Gly | Cys | Tyr |
| Ala | Val | Cys | Cys | Glu | Trp | Cys | Cys | Thr | Pro | Ala | Cys | Thr | Gly | D-Cys | — |
| Ala | Val | Cys | Cys | Glu | Trp | Cys | Cys | Thr | Pro | Ala | Cys | Thr | Gly | D-Cys | Lys |
| Ala | Val | Cys | Cys | Glu | Trp | Cys | Cys | Thr | Pro | Ala | Cys | Thr | Gly | D-Cys | Tyr |
| Ala | Val | Cys | Cys | Glu | Trp | D-Cys | Cys | Asn | Pro | Ala | Cys | Thr | Gly | Cys | — |
| Ala | Val | Cys | Cys | Glu | Trp | D-Cys | Cys | Asn | Pro | Ala | Cys | Thr | Gly | Cys | Lys |
| Ala | Val | Cys | Cys | Glu | Trp | D-Cys | Cys | Asn | Pro | Ala | Cys | Thr | Gly | Cys | Tyr |

FIG. 3A-55

| | | | | | | | | | | | | | | |
|---|---|---|---|---|---|---|---|---|---|---|---|---|---|---|
| Ala | Val | Cys | Cys | Glu | Trp | D-Cys | Cys | Asn | Pro | Ala | Cys | Thr | Gly | D-Cys | — |
| Ala | Val | Cys | Cys | Glu | Trp | D-Cys | Cys | Asn | Pro | Ala | Cys | Thr | Gly | D-Cys | Lys |
| Ala | Val | Cys | Cys | Glu | Trp | D-Cys | Cys | Asn | Pro | Ala | Cys | Thr | Gly | D-Cys | Tyr |
| Ala | Val | Cys | Cys | Glu | Trp | D-Cys | Cys | Thr | Pro | Ala | Cys | Thr | Gly | Cys | — |
| Ala | Val | Cys | Cys | Glu | Trp | D-Cys | Cys | Thr | Pro | Ala | Cys | Thr | Gly | Cys | Lys |
| Ala | Val | Cys | Cys | Glu | Trp | D-Cys | Cys | Thr | Pro | Ala | Cys | Thr | Gly | Cys | Tyr |
| Ala | Val | Cys | Cys | Glu | Trp | D-Cys | Cys | Thr | Pro | Ala | Cys | Thr | Gly | D-Cys | — |
| Ala | Val | Cys | Cys | Glu | Trp | D-Cys | Cys | Thr | Pro | Ala | Cys | Thr | Gly | D-Cys | Lys |
| Ala | Val | Cys | Cys | Glu | Trp | D-Cys | Cys | Thr | Pro | Ala | Cys | Thr | Gly | D-Cys | Tyr |
| Ala | Val | D-Cys | Cys | Glu | Val | Cys | Cys | Asn | Pro | Ala | Cys | Thr | Gly | Cys | — |
| Ala | Val | D-Cys | Cys | Glu | Val | Cys | Cys | Asn | Pro | Ala | Cys | Thr | Gly | Cys | Lys |
| Ala | Val | D-Cys | Cys | Glu | Val | Cys | Cys | Asn | Pro | Ala | Cys | Thr | Gly | Cys | Tyr |
| Ala | Val | D-Cys | Cys | Glu | Val | Cys | Cys | Asn | Pro | Ala | Cys | Thr | Gly | D-Cys | — |
| Ala | Val | D-Cys | Cys | Glu | Val | Cys | Cys | Asn | Pro | Ala | Cys | Thr | Gly | D-Cys | Lys |
| Ala | Val | D-Cys | Cys | Glu | Val | Cys | Cys | Asn | Pro | Ala | Cys | Thr | Gly | D-Cys | Tyr |
| Ala | Val | D-Cys | Cys | Glu | Val | Cys | Cys | Thr | Pro | Ala | Cys | Thr | Gly | Cys | — |
| Ala | Val | D-Cys | Cys | Glu | Val | Cys | Cys | Thr | Pro | Ala | Cys | Thr | Gly | Cys | Lys |
| Ala | Val | D-Cys | Cys | Glu | Val | Cys | Cys | Thr | Pro | Ala | Cys | Thr | Gly | Cys | Tyr |
| Ala | Val | D-Cys | Cys | Glu | Val | Cys | Cys | Thr | Pro | Ala | Cys | Thr | Gly | D-Cys | — |
| Ala | Val | D-Cys | Cys | Glu | Val | Cys | Cys | Thr | Pro | Ala | Cys | Thr | Gly | D-Cys | Lys |
| Ala | Val | D-Cys | Cys | Glu | Val | Cys | Cys | Thr | Pro | Ala | Cys | Thr | Gly | D-Cys | Tyr |
| Ala | Val | D-Cys | Cys | Glu | Val | D-Cys | Cys | Asn | Pro | Ala | Cys | Thr | Gly | Cys | — |
| Ala | Val | D-Cys | Cys | Glu | Val | D-Cys | Cys | Asn | Pro | Ala | Cys | Thr | Gly | Cys | Lys |
| Ala | Val | D-Cys | Cys | Glu | Val | D-Cys | Cys | Asn | Pro | Ala | Cys | Thr | Gly | Cys | Tyr |
| Ala | Val | D-Cys | Cys | Glu | Val | D-Cys | Cys | Asn | Pro | Ala | Cys | Thr | Gly | D-Cys | — |
| Ala | Val | D-Cys | Cys | Glu | Val | D-Cys | Cys | Asn | Pro | Ala | Cys | Thr | Gly | D-Cys | Lys |
| Ala | Val | D-Cys | Cys | Glu | Val | D-Cys | Cys | Asn | Pro | Ala | Cys | Thr | Gly | D-Cys | Tyr |
| Ala | Val | D-Cys | Cys | Glu | Val | D-Cys | Cys | Thr | Pro | Ala | Cys | Thr | Gly | Cys | — |
| Ala | Val | D-Cys | Cys | Glu | Val | D-Cys | Cys | Thr | Pro | Ala | Cys | Thr | Gly | Cys | Lys |
| Ala | Val | D-Cys | Cys | Glu | Val | D-Cys | Cys | Thr | Pro | Ala | Cys | Thr | Gly | Cys | Tyr |
| Ala | Val | D-Cys | Cys | Glu | Val | D-Cys | Cys | Thr | Pro | Ala | Cys | Thr | Gly | D-Cys | — |
| Ala | Val | D-Cys | Cys | Glu | Val | D-Cys | Cys | Thr | Pro | Ala | Cys | Thr | Gly | D-Cys | Lys |
| Ala | Val | D-Cys | Cys | Glu | Val | D-Cys | Cys | Thr | Pro | Ala | Cys | Thr | Gly | D-Cys | Tyr |
| Ala | Val | D-Cys | Cys | Glu | Ile | Cys | Cys | Asn | Pro | Ala | Cys | Thr | Gly | Cys | — |
| Ala | Val | D-Cys | Cys | Glu | Ile | Cys | Cys | Asn | Pro | Ala | Cys | Thr | Gly | Cys | Lys |
| Ala | Val | D-Cys | Cys | Glu | Ile | Cys | Cys | Asn | Pro | Ala | Cys | Thr | Gly | Cys | Tyr |
| Ala | Val | D-Cys | Cys | Glu | Ile | Cys | Cys | Asn | Pro | Ala | Cys | Thr | Gly | D-Cys | — |
| Ala | Val | D-Cys | Cys | Glu | Ile | Cys | Cys | Asn | Pro | Ala | Cys | Thr | Gly | D-Cys | Lys |
| Ala | Val | D-Cys | Cys | Glu | Ile | Cys | Cys | Asn | Pro | Ala | Cys | Thr | Gly | D-Cys | Tyr |
| Ala | Val | D-Cys | Cys | Glu | Ile | Cys | Cys | Thr | Pro | Ala | Cys | Thr | Gly | Cys | — |
| Ala | Val | D-Cys | Cys | Glu | Ile | Cys | Cys | Thr | Pro | Ala | Cys | Thr | Gly | Cys | Lys |
| Ala | Val | D-Cys | Cys | Glu | Ile | Cys | Cys | Thr | Pro | Ala | Cys | Thr | Gly | Cys | Tyr |
| Ala | Val | D-Cys | Cys | Glu | Ile | Cys | Cys | Thr | Pro | Ala | Cys | Thr | Gly | D-Cys | — |
| Ala | Val | D-Cys | Cys | Glu | Ile | Cys | Cys | Thr | Pro | Ala | Cys | Thr | Gly | D-Cys | Lys |
| Ala | Val | D-Cys | Cys | Glu | Ile | Cys | Cys | Thr | Pro | Ala | Cys | Thr | Gly | D-Cys | Tyr |
| Ala | Val | D-Cys | Cys | Glu | Ile | D-Cys | Cys | Asn | Pro | Ala | Cys | Thr | Gly | Cys | — |
| Ala | Val | D-Cys | Cys | Glu | Ile | D-Cys | Cys | Asn | Pro | Ala | Cys | Thr | Gly | Cys | Lys |
| Ala | Val | D-Cys | Cys | Glu | Ile | D-Cys | Cys | Asn | Pro | Ala | Cys | Thr | Gly | Cys | Tyr |
| Ala | Val | D-Cys | Cys | Glu | Ile | D-Cys | Cys | Asn | Pro | Ala | Cys | Thr | Gly | D-Cys | — |
| Ala | Val | D-Cys | Cys | Glu | Ile | D-Cys | Cys | Asn | Pro | Ala | Cys | Thr | Gly | D-Cys | Lys |
| Ala | Val | D-Cys | Cys | Glu | Ile | D-Cys | Cys | Asn | Pro | Ala | Cys | Thr | Gly | D-Cys | Tyr |
| Ala | Val | D-Cys | Cys | Glu | Ile | D-Cys | Cys | Thr | Pro | Ala | Cys | Thr | Gly | Cys | — |
| Ala | Val | D-Cys | Cys | Glu | Ile | D-Cys | Cys | Thr | Pro | Ala | Cys | Thr | Gly | Cys | Lys |
| Ala | Val | D-Cys | Cys | Glu | Ile | D-Cys | Cys | Thr | Pro | Ala | Cys | Thr | Gly | Cys | Tyr |
| Ala | Val | D-Cys | Cys | Glu | Ile | D-Cys | Cys | Thr | Pro | Ala | Cys | Thr | Gly | D-Cys | — |
| Ala | Val | D-Cys | Cys | Glu | Ile | D-Cys | Cys | Thr | Pro | Ala | Cys | Thr | Gly | D-Cys | Lys |
| Ala | Val | D-Cys | Cys | Glu | Ile | D-Cys | Cys | Thr | Pro | Ala | Cys | Thr | Gly | D-Cys | Tyr |
| Ala | Val | D-Cys | Cys | Glu | Leu | Cys | Cys | Asn | Pro | Ala | Cys | Thr | Gly | Cys | — |
| Ala | Val | D-Cys | Cys | Glu | Leu | Cys | Cys | Asn | Pro | Ala | Cys | Thr | Gly | Cys | Lys |
| Ala | Val | D-Cys | Cys | Glu | Leu | Cys | Cys | Asn | Pro | Ala | Cys | Thr | Gly | Cys | Tyr |

FIG. 3A-56

| Ala | Val | D-Cys | Cys | Glu | Leu | Cys | Cys | Asn | Pro | Ala | Cys | Thr | Gly | D-Cys | — |
|---|---|---|---|---|---|---|---|---|---|---|---|---|---|---|---|
| Ala | Val | D-Cys | Cys | Glu | Leu | Cys | Cys | Asn | Pro | Ala | Cys | Thr | Gly | D-Cys | Lys |
| Ala | Val | D-Cys | Cys | Glu | Leu | Cys | Cys | Asn | Pro | Ala | Cys | Thr | Gly | D-Cys | Tyr |
| Ala | Val | D-Cys | Cys | Glu | Leu | Cys | Cys | Thr | Pro | Ala | Cys | Thr | Gly | Cys | — |
| Ala | Val | D-Cys | Cys | Glu | Leu | Cys | Cys | Thr | Pro | Ala | Cys | Thr | Gly | Cys | Lys |
| Ala | Val | D-Cys | Cys | Glu | Leu | Cys | Cys | Thr | Pro | Ala | Cys | Thr | Gly | Cys | Tyr |
| Ala | Val | D-Cys | Cys | Glu | Leu | Cys | Cys | Thr | Pro | Ala | Cys | Thr | Gly | D-Cys | — |
| Ala | Val | D-Cys | Cys | Glu | Leu | Cys | Cys | Thr | Pro | Ala | Cys | Thr | Gly | D-Cys | Lys |
| Ala | Val | D-Cys | Cys | Glu | Leu | Cys | Cys | Thr | Pro | Ala | Cys | Thr | Gly | D-Cys | Tyr |
| Ala | Val | D-Cys | Cys | Glu | Leu | D-Cys | Cys | Asn | Pro | Ala | Cys | Thr | Gly | Cys | — |
| Ala | Val | D-Cys | Cys | Glu | Leu | D-Cys | Cys | Asn | Pro | Ala | Cys | Thr | Gly | Cys | Lys |
| Ala | Val | D-Cys | Cys | Glu | Leu | D-Cys | Cys | Asn | Pro | Ala | Cys | Thr | Gly | Cys | Tyr |
| Ala | Val | D-Cys | Cys | Glu | Leu | D-Cys | Cys | Asn | Pro | Ala | Cys | Thr | Gly | D-Cys | — |
| Ala | Val | D-Cys | Cys | Glu | Leu | D-Cys | Cys | Asn | Pro | Ala | Cys | Thr | Gly | D-Cys | Lys |
| Ala | Val | D-Cys | Cys | Glu | Leu | D-Cys | Cys | Asn | Pro | Ala | Cys | Thr | Gly | D-Cys | Tyr |
| Ala | Val | D-Cys | Cys | Glu | Leu | D-Cys | Cys | Thr | Pro | Ala | Cys | Thr | Gly | Cys | — |
| Ala | Val | D-Cys | Cys | Glu | Leu | D-Cys | Cys | Thr | Pro | Ala | Cys | Thr | Gly | Cys | Lys |
| Ala | Val | D-Cys | Cys | Glu | Leu | D-Cys | Cys | Thr | Pro | Ala | Cys | Thr | Gly | Cys | Tyr |
| Ala | Val | D-Cys | Cys | Glu | Leu | D-Cys | Cys | Thr | Pro | Ala | Cys | Thr | Gly | D-Cys | — |
| Ala | Val | D-Cys | Cys | Glu | Leu | D-Cys | Cys | Thr | Pro | Ala | Cys | Thr | Gly | D-Cys | Lys |
| Ala | Val | D-Cys | Cys | Glu | Leu | D-Cys | Cys | Thr | Pro | Ala | Cys | Thr | Gly | D-Cys | Tyr |
| Ala | Val | D-Cys | Cys | Glu | Tyr | Cys | Cys | Asn | Pro | Ala | Cys | Thr | Gly | Cys | — |
| Ala | Val | D-Cys | Cys | Glu | Tyr | Cys | Cys | Asn | Pro | Ala | Cys | Thr | Gly | Cys | Lys |
| Ala | Val | D-Cys | Cys | Glu | Tyr | Cys | Cys | Asn | Pro | Ala | Cys | Thr | Gly | Cys | Tyr |
| Ala | Val | D-Cys | Cys | Glu | Tyr | Cys | Cys | Asn | Pro | Ala | Cys | Thr | Gly | D-Cys | — |
| Ala | Val | D-Cys | Cys | Glu | Tyr | Cys | Cys | Asn | Pro | Ala | Cys | Thr | Gly | D-Cys | Lys |
| Ala | Val | D-Cys | Cys | Glu | Tyr | Cys | Cys | Asn | Pro | Ala | Cys | Thr | Gly | D-Cys | Tyr |
| Ala | Val | D-Cys | Cys | Glu | Tyr | Cys | Cys | Thr | Pro | Ala | Cys | Thr | Gly | Cys | — |
| Ala | Val | D-Cys | Cys | Glu | Tyr | Cys | Cys | Thr | Pro | Ala | Cys | Thr | Gly | Cys | Lys |
| Ala | Val | D-Cys | Cys | Glu | Tyr | Cys | Cys | Thr | Pro | Ala | Cys | Thr | Gly | Cys | Tyr |
| Ala | Val | D-Cys | Cys | Glu | Tyr | Cys | Cys | Thr | Pro | Ala | Cys | Thr | Gly | D-Cys | — |
| Ala | Val | D-Cys | Cys | Glu | Tyr | Cys | Cys | Thr | Pro | Ala | Cys | Thr | Gly | D-Cys | Lys |
| Ala | Val | D-Cys | Cys | Glu | Tyr | Cys | Cys | Thr | Pro | Ala | Cys | Thr | Gly | D-Cys | Tyr |
| Ala | Val | D-Cys | Cys | Glu | Tyr | D-Cys | Cys | Asn | Pro | Ala | Cys | Thr | Gly | Cys | — |
| Ala | Val | D-Cys | Cys | Glu | Tyr | D-Cys | Cys | Asn | Pro | Ala | Cys | Thr | Gly | Cys | Lys |
| Ala | Val | D-Cys | Cys | Glu | Tyr | D-Cys | Cys | Asn | Pro | Ala | Cys | Thr | Gly | Cys | Tyr |
| Ala | Val | D-Cys | Cys | Glu | Tyr | D-Cys | Cys | Asn | Pro | Ala | Cys | Thr | Gly | D-Cys | — |
| Ala | Val | D-Cys | Cys | Glu | Tyr | D-Cys | Cys | Asn | Pro | Ala | Cys | Thr | Gly | D-Cys | Lys |
| Ala | Val | D-Cys | Cys | Glu | Tyr | D-Cys | Cys | Asn | Pro | Ala | Cys | Thr | Gly | D-Cys | Tyr |
| Ala | Val | D-Cys | Cys | Glu | Tyr | D-Cys | Cys | Thr | Pro | Ala | Cys | Thr | Gly | Cys | — |
| Ala | Val | D-Cys | Cys | Glu | Tyr | D-Cys | Cys | Thr | Pro | Ala | Cys | Thr | Gly | Cys | Lys |
| Ala | Val | D-Cys | Cys | Glu | Tyr | D-Cys | Cys | Thr | Pro | Ala | Cys | Thr | Gly | Cys | Tyr |
| Ala | Val | D-Cys | Cys | Glu | Tyr | D-Cys | Cys | Thr | Pro | Ala | Cys | Thr | Gly | D-Cys | — |
| Ala | Val | D-Cys | Cys | Glu | Tyr | D-Cys | Cys | Thr | Pro | Ala | Cys | Thr | Gly | D-Cys | Lys |
| Ala | Val | D-Cys | Cys | Glu | Tyr | D-Cys | Cys | Thr | Pro | Ala | Cys | Thr | Gly | D-Cys | Tyr |
| Ala | Val | D-Cys | Cys | Glu | Phe | Cys | Cys | Asn | Pro | Ala | Cys | Thr | Gly | Cys | — |
| Ala | Val | D-Cys | Cys | Glu | Phe | Cys | Cys | Asn | Pro | Ala | Cys | Thr | Gly | Cys | Lys |
| Ala | Val | D-Cys | Cys | Glu | Phe | Cys | Cys | Asn | Pro | Ala | Cys | Thr | Gly | Cys | Tyr |
| Ala | Val | D-Cys | Cys | Glu | Phe | Cys | Cys | Asn | Pro | Ala | Cys | Thr | Gly | D-Cys | — |
| Ala | Val | D-Cys | Cys | Glu | Phe | Cys | Cys | Asn | Pro | Ala | Cys | Thr | Gly | D-Cys | Lys |
| Ala | Val | D-Cys | Cys | Glu | Phe | Cys | Cys | Asn | Pro | Ala | Cys | Thr | Gly | D-Cys | Tyr |
| Ala | Val | D-Cys | Cys | Glu | Phe | Cys | Cys | Thr | Pro | Ala | Cys | Thr | Gly | Cys | — |
| Ala | Val | D-Cys | Cys | Glu | Phe | Cys | Cys | Thr | Pro | Ala | Cys | Thr | Gly | Cys | Lys |
| Ala | Val | D-Cys | Cys | Glu | Phe | Cys | Cys | Thr | Pro | Ala | Cys | Thr | Gly | Cys | Tyr |
| Ala | Val | D-Cys | Cys | Glu | Phe | Cys | Cys | Thr | Pro | Ala | Cys | Thr | Gly | D-Cys | — |
| Ala | Val | D-Cys | Cys | Glu | Phe | Cys | Cys | Thr | Pro | Ala | Cys | Thr | Gly | D-Cys | Lys |
| Ala | Val | D-Cys | Cys | Glu | Phe | Cys | Cys | Thr | Pro | Ala | Cys | Thr | Gly | D-Cys | Tyr |
| Ala | Val | D-Cys | Cys | Glu | Phe | D-Cys | Cys | Asn | Pro | Ala | Cys | Thr | Gly | Cys | — |
| Ala | Val | D-Cys | Cys | Glu | Phe | D-Cys | Cys | Asn | Pro | Ala | Cys | Thr | Gly | Cys | Lys |
| Ala | Val | D-Cys | Cys | Glu | Phe | D-Cys | Cys | Asn | Pro | Ala | Cys | Thr | Gly | Cys | Tyr |

FIG. 3A-57

| Ala | Val | D-Cys | Cys | Glu | Phe | D-Cys | Cys | Asn | Pro | Ala | Cys | Thr | Gly | D-Cys | --- |
|---|---|---|---|---|---|---|---|---|---|---|---|---|---|---|---|
| Ala | Val | D-Cys | Cys | Glu | Phe | D-Cys | Cys | Asn | Pro | Ala | Cys | Thr | Gly | D-Cys | Lys |
| Ala | Val | D-Cys | Cys | Glu | Phe | D-Cys | Cys | Asn | Pro | Ala | Cys | Thr | Gly | D-Cys | Tyr |
| Ala | Val | D-Cys | Cys | Glu | Phe | D-Cys | Cys | Thr | Pro | Ala | Cys | Thr | Gly | Cys | --- |
| Ala | Val | D-Cys | Cys | Glu | Phe | D-Cys | Cys | Thr | Pro | Ala | Cys | Thr | Gly | Cys | Lys |
| Ala | Val | D-Cys | Cys | Glu | Phe | D-Cys | Cys | Thr | Pro | Ala | Cys | Thr | Gly | Cys | Tyr |
| Ala | Val | D-Cys | Cys | Glu | Phe | D-Cys | Cys | Thr | Pro | Ala | Cys | Thr | Gly | D-Cys | --- |
| Ala | Val | D-Cys | Cys | Glu | Phe | D-Cys | Cys | Thr | Pro | Ala | Cys | Thr | Gly | D-Cys | Lys |
| Ala | Val | D-Cys | Cys | Glu | Phe | D-Cys | Cys | Thr | Pro | Ala | Cys | Thr | Gly | D-Cys | Tyr |
| Ala | Val | D-Cys | Cys | Glu | Trp | Cys | Cys | Asn | Pro | Ala | Cys | Thr | Gly | Cys | --- |
| Ala | Val | D-Cys | Cys | Glu | Trp | Cys | Cys | Asn | Pro | Ala | Cys | Thr | Gly | Cys | Lys |
| Ala | Val | D-Cys | Cys | Glu | Trp | Cys | Cys | Asn | Pro | Ala | Cys | Thr | Gly | Cys | Tyr |
| Ala | Val | D-Cys | Cys | Glu | Trp | Cys | Cys | Asn | Pro | Ala | Cys | Thr | Gly | D-Cys | --- |
| Ala | Val | D-Cys | Cys | Glu | Trp | Cys | Cys | Asn | Pro | Ala | Cys | Thr | Gly | D-Cys | Lys |
| Ala | Val | D-Cys | Cys | Glu | Trp | Cys | Cys | Asn | Pro | Ala | Cys | Thr | Gly | D-Cys | Tyr |
| Ala | Val | D-Cys | Cys | Glu | Trp | Cys | Cys | Thr | Pro | Ala | Cys | Thr | Gly | Cys | --- |
| Ala | Val | D-Cys | Cys | Glu | Trp | Cys | Cys | Thr | Pro | Ala | Cys | Thr | Gly | Cys | Lys |
| Ala | Val | D-Cys | Cys | Glu | Trp | Cys | Cys | Thr | Pro | Ala | Cys | Thr | Gly | Cys | Tyr |
| Ala | Val | D-Cys | Cys | Glu | Trp | Cys | Cys | Thr | Pro | Ala | Cys | Thr | Gly | D-Cys | --- |
| Ala | Val | D-Cys | Cys | Glu | Trp | Cys | Cys | Thr | Pro | Ala | Cys | Thr | Gly | D-Cys | Lys |
| Ala | Val | D-Cys | Cys | Glu | Trp | Cys | Cys | Thr | Pro | Ala | Cys | Thr | Gly | D-Cys | Tyr |
| Ala | Val | D-Cys | Cys | Glu | Trp | D-Cys | Cys | Asn | Pro | Ala | Cys | Thr | Gly | Cys | --- |
| Ala | Val | D-Cys | Cys | Glu | Trp | D-Cys | Cys | Asn | Pro | Ala | Cys | Thr | Gly | Cys | Lys |
| Ala | Val | D-Cys | Cys | Glu | Trp | D-Cys | Cys | Asn | Pro | Ala | Cys | Thr | Gly | Cys | Tyr |
| Ala | Val | D-Cys | Cys | Glu | Trp | D-Cys | Cys | Asn | Pro | Ala | Cys | Thr | Gly | D-Cys | --- |
| Ala | Val | D-Cys | Cys | Glu | Trp | D-Cys | Cys | Asn | Pro | Ala | Cys | Thr | Gly | D-Cys | Lys |
| Ala | Val | D-Cys | Cys | Glu | Trp | D-Cys | Cys | Asn | Pro | Ala | Cys | Thr | Gly | D-Cys | Tyr |
| Ala | Val | D-Cys | Cys | Glu | Trp | D-Cys | Cys | Thr | Pro | Ala | Cys | Thr | Gly | Cys | --- |
| Ala | Val | D-Cys | Cys | Glu | Trp | D-Cys | Cys | Thr | Pro | Ala | Cys | Thr | Gly | Cys | Lys |
| Ala | Val | D-Cys | Cys | Glu | Trp | D-Cys | Cys | Thr | Pro | Ala | Cys | Thr | Gly | Cys | Tyr |
| Ala | Val | D-Cys | Cys | Glu | Trp | D-Cys | Cys | Thr | Pro | Ala | Cys | Thr | Gly | D-Cys | --- |
| Ala | Val | D-Cys | Cys | Glu | Trp | D-Cys | Cys | Thr | Pro | Ala | Cys | Thr | Gly | D-Cys | Lys |
| Ala | Val | D-Cys | Cys | Glu | Trp | D-Cys | Cys | Thr | Pro | Ala | Cys | Thr | Gly | D-Cys | Tyr |

| Seq ID NO: | Sequence |
|---|---|
| SEQ ID NO. 1 | (D-Cys)-Cys-Glu-Tyr-Cys-Cys-Asn-Pro-Ala-Cys-Thr-Gly-Cys-Tyr |
| SEQ ID NO. 2 | Cys-Cys-Glu-Tyr-Cys-Cys-Asn-Pro-Ala-Cys-Thr-Gly-Cys-Lys |
| SEQ ID NO. 3 | Cys-Cys-Glu-Phe-Cys-Cys-Asn-Pro-Ala-Cys-Thr-Gly-Cys-Tyr |
| SEQ ID NO. 4 | Cys-Cys-Glu-Trp-Cys-Cys-Asn-Pro-Ala-Cys-Thr-Gly-Cys-Tyr |
| SEQ ID NO. 5 | Cys-Cys-Glu-Tyr-Cys-Cys-Thr-Pro-Ala-Cys-Thr-Gly-Cys-Tyr |
| SEQ ID NO. 6 | Cys-Cys-Glu-Leu-Cys-Cys-Asn-Pro-Ala-Cys-Thr-Gly-Cys-Tyr |

| Pre Sequence | Pro sequence | pre-pro sequence | Processed Active peptide (mature form) | N-terminal non-core | active "core" | c terminal non-core | Full length (includes pre-pro-mature) | Pro-Processed Active (without pre) | Pre-Processed Active (without the pro) |
|---|---|---|---|---|---|---|---|---|---|
| MKKLMLAI FISVLSFPSF S | QSTESLDSS KEKITLETK KCDVVKNN SEKKSENM N | MKKLMLAIFISVLS FPSFSQSTESLDSS KEKITLETKKCDV VKNNSEKKSENM N | NTFYCCELCC NPACAGCY | NTFY | CCELCCNPA CAGC | Y | MKKLMLAIFISVLSFPSF SQSTESLDSSKEKITLET KKCDVVKNNSEKKSEN MNNTFYCCELCCNPAC AGCY | QSTESLDSSKE KITLETKKCDV VKNNSEKKSEN MNNTFYCCELC CNPACAGCY | MKKLMLAIFIS VLSFPSFSNTF YCCELCCNPA CAGCY |
| MKKLMLAI FISVLSFPSF S | QSTESLDSS KEKITLETK KCDVVKNN SEKKSENM N | MKKLMLAIFISVLS FPSFSQSTESLDSS KEKITLETKKCDV VKNNSEKKSENM N | NTFYCCELCC NPACAPCY | NTFY | CCELCCNPA CAPC | Y | MKKLMLAIFISVLSFPSF SQSTESLDSSKEKITLET KKCDVVKNNSEKKSEN MNNTFYCCELCCNPAC APCY | QSTESLDSSKE KITLETKKCDV VKNNSEKKSEN MNNTFYCCELC CNPACAPCY | MKKLMLAIFIS VLSFPSFSNTF YCCELCCNPA CAPCY |
| MKKSILFIF LSVLSFSPF P | QDAKPVESS KEKITLESK KCNIAKKSN KSGPESM | MKKSILFIFLSVLSF SPFPQDAKPVESSK EKITLESKKCNIAK KSNKSGPESM | NSSNYCCELC CNPACTGCY | NSSNY | CCELCCNPA CTGC | Y | MKKSILFIFLSVLSFSPF PQDAKPVESSKEKITLE SKKCNIAKKSNKSGPES MNSSNYCCELCCNPAC TGCY | QDAKPVESSKE KITLESKKCNIA KKSNKSGPESM NSSNYCCELCC NPACTGCY | MKKSILFIFLS VLSFSPFPNSS NYCCELCCNP ACTGCY |
| MKKSILFIF LSVLSFSPF A | QDAKPVESS KEKITLESK KCNIAKKSN KSGPESM | MKKSILFIFLSVLSF SPFAQDAKPVESS KEKITLESKKCNIA KKSNKSGPESM | NSSNYCCELC CNPACTGCY | NSSNY | CCELCCNPA CTGC | Y | MKKSILFIFLSVLSFSPF AQDAKPVESSKEKITLE SKKCNIAKKSNKSGPES MNSSNYCCELCCNPAC TGCY | QDAKPVESSKE KITLESKKCNIA KKSNKSGPESM NSSNYCCELCC NPACTGCY | MKKSILFIFLS VLSFSPFANSS NYCCELCCNP ACTGCY |
| MKKSILFIF LSVLSFSPF A | QDAKPAGSS KEKITLESK KCNIVKKN NESSPESM | MKKSILFIFLSVLSF SPFAQDAKPAGSS KEKITLESKKCNIV KKNESSPESM | NSSNYCCELC CNPACTGCY | NSSNY | CCELCCNPA CTGC | Y | MKKSILFIFLSVLSFSPF AQDAKPAGSSKEKITLE SKKCNIVKKNNESSPES MNSSNYCCELCCNPAC TGCY | QDAKPAGSSKE KITLESKKCNIV KKNNESSPESM NSSNYCCELCC NPACTGCY | MKKSILFIFLS VLSFSPFANSS NYCCELCCNP ACTGCY |
| MKKSILFIF LSVLSFSPF A | QDAKPVESS KEKITLESK KCNIAKKSN KSGPESM | MKKSILFIFLSVLSF SPFAQDAKPVESS KEKITLESKKCNIA KKSNKSGPESM | NSSNYCCELC CNPACTGCY | NSSNY | CCELCCNPA CTGC | Y | MKKSILFIFLSVLSFSPF AQDAKPVESSKEKITLE SKKCNIAKKSNKSGPES MNSSNYCCELCCNPAC TGCY | QDAKPVESSKE KITLESKKCNIA KKSNKSGPESM NSSNYCCELCC NPACTGCY | MKKSILFIFLS VLSFSPFANSS NYCCELCCNP ACTGCY |
| N/A | VLSFSPFAQ DAKPVESSK EKITLESKK CNIAKKSNK SDPESM | n/a | | NSSNY | CCELCCNPA CTGC | Y | N/A | VLSFSPFAQDA KPVESSKEKITL ESKKCNIAKKS NKSDPESMNSS NYCCELCCNPA CTGCY | N/A |
| MKKIVFVL VLMLSSFG AFG | QETVSGQFS DALSTPITA EVYKQACD PPLPPAEV | MKKIVFVLVLMLS SFGAFGQETVSGQ FSDALSTPITAEVY KQACDPPLPPAEV | SSDWDCCDV CCNPACAGC | SSDWD | CCDVCCNPA CAGC | none identified | MKKIVFVLVLMLSSFG AFGQETVSGQFSDALST PITAEVYKQACDPPLPP AEVSSDWDCCDVCCNP ACAGC | QETVSGQFSDA LSTPITAEVYKQ ACDPPLPPAEV SSDWDCCDVC CNPACAGC | MKKIVFVLVL MLSSFGAFGSS DWDCCDVCC NPACAGC |
| MKKIVFVL VLMLSSFG AFG | QETVSGQFS DALSTPITA EVYKQACD PSPPAEV | MKKIVFVLVLMLS SFGAFGQETVSGQ FSDALSTPITAEVY KQACDPPSPPAEV | SSDWDCCDV CCNPACAGC | SSDWD | CCDVCCNPA CAGC | none identified | MKKIVFVLVLMLSSFG AFGQETVSGQFSDALST PITAEVYKQACDPPSPP AEVSSDWDCCDVCCNP ACAGC | QETVSGQFSDA LSTPITAEVYKQ ACDPPSPPAEV SSDWDCCDVC CNPACAGC | MKKIVFVLVL MLSSFGAFGSS DWDCCDVCC NPACAGC |

FIG. 4-1

| Pre Sequence | Pro sequence | pre-pro sequence | Processed Active peptide (mature form) | N-terminal non-core | active "core" | c terminal non-core | Full length (includes pre-pro-mature) | Pro-Processed Active (without pre) | Pre-Processed Active (without the pro) |
|---|---|---|---|---|---|---|---|---|---|
| N/A | QACDPPSPPAEV | n/a | SSDWDCCDVCCNPACAGC | SSDWD | CCDVCCNPACAGC | none identified | N/A | QACDPPSPPAEVSSDWDCCDVCCNPACAGC | N/A |
| MKKIILALVLMLFSFCTLG | QETASMHLDDTLSAPIAAEINRKACDTQTPSPS | MKKIILALVLMLFSFCTLGQETASMHLDDTLSAPIAAEINRKACDTQTPSPS | EENDDWCCEVCCNPACAGC | EENDDW | CCEVCCNPACAGC | none identified | MKKIILALVLMLFSFCTLGQETASMHLDDTLSAPIAAEINRKACDTQTPSPSEENDDWCCEVCCNPACAGC | QETASMHLDDTLSAPIAAEINRKACDTQTPSPSEENDDWCCEVCCNPACAGC | MKKIILALVLMLFSFCTLGEENDDWCCEVCCNPACAGC |
| N/A | KACDTQTPSPS | n/a | EENDDWCCEVCCNPACAGC | EENDDW | CCEVCCNPACAGC | none identified | N/A | KACDTQTPSPSEENDDWCCEVCCNPACAGC | N/A |
| MKKIVFVLTLMLFSFGTLG | QETASGQVGDVSSSTIATEVSEAECGTQSATTQG | MKKIVFVLTLMLFSFGTLGQETASGQVGDVSSSTIATEVSEAECGTQSATTQG | ENDWDWCCELCCNPACFGC | ENDWDW | CCELCCNPACFGC | none identified | MKKIVFVLTLMLFSFGTLGQETASGQVGDVSSSTIATEVSEAECGTQSATTQGENDWDWCCELCCNPACFGC | QETASGQVGDVSSSTIATEVSEAECGTQSATTQGENDWDWCCELCCNPACFGC | MKKIVFVLTLMLFSFGTLGENDWDWCCELCCNPACFGC |
| MKKIVFVLVLMLSSFGTFG | QETASRQFGDAFSTPIAAEVNKKACDTELPP | MKKIVFVLVLMLSSFGTFGQETASRQFGDAFSTPIAAEVNKKACDTELPP | SDWCCEVCCNPACAGC | SDW | CCEVCCNPACAGC | none identified | MKKIVFVLVLMLSSFGTFGQETASRQFGDAFSTPIAAEVNKKACDTELPPSDWCCEVCCNPACAGC | QETASRQFGDAFSTPIAAEVNKKACDTELPPSDWCCEVCCNPACAGC | MKKIVFVLVLMLSSFGTFGSDWCCEVCCNPACAGC |
| N/A | N/A | n/a | LIDCCEICCNPACFGCLN | LID | CCEICCNPACFGC | LN | N/A | N/A | N/A |
| N/A | N/A | n/a | NLIDCCEICCNPACFGCLN | NLID | CCEICCNPACFGC | LN | N/A | N/A | N/A |
| N/A | N/A | n/a | FIKQVDENGNLIDCCEICCNPACFGCLN | FIKQVDENGNLID | CCEICCNPACFGC | LN | N/A | N/A | N/A |
| MKNLFIALMLLFSSIALS | QTVENDTKTVQQPQIESKVNIKKLSENEECPFIKQVDENGNL | MKNLFIALMLLFSSIALSQTVENDTKTVQQPQIESKVNIKKLSENEECPFIKQVDENGNL | IDCCEICCNPACFGCLN | ID | CCEICCNPACFGC | LN | MKNLFIALMLLFSSIALSQTVENDTKTVQQPQIESKVNIKKLSENEECPFIKQVDENGNLIDCCEICCNPACFGCLN | QTVENDTKTVQQPQIESKVNIKKLSENEECPFIKQVDENGNLIDCCEICCNPACFGCLN | MKNLFIALMLLFSSIALSIDCCEICCNPACFGCLN |

FIG. 4-2

| Pre Sequence | Pro sequence | pre-pro sequence | Processed Active peptide (mature form) | N-terminal non-core | active "core" | c terminal non-core | Full length (includes pre-pro-mature) | Pro-Processed Active (without pre) | Pre-Processed Active (without the pro) |
|---|---|---|---|---|---|---|---|---|---|
| MRNLFIA LMLLFSSI AFS | QTVENNK KTVQQPQ QIESKVNI KKLSENEE CPFIKQVD ENGNL | MRNLFIALMLLF SSIAFSQTVENN KKTVQQPQQIES KVNIKKLSENEE CPFIKQVDENGN L | IDCCEICCNP ACFGCLN | ID | CCEICCNP ACFGC | LN | MRNLFIALMLLFSSI AFSQTVENNKKTVQ QPQQIESKVNIKKLS ENEECPFIKQVDENG NLIDCCEICCNPACF GCLN | QTVENNKKT VQQPQQIESK VNIKKLSENE ECPFIKQVDE NGNLIDCCEI CCNPACFGCL N | MRNLFIALM LLFSSIAFSID CCEICCNPA CFGCLN |
| MKNLFIA LMLLFSSI AFS | RTVEDNK KTVQQPQ QIESKVNI KKPSENEE CPVIKQVD ENGNL | MKNLFIALMLLF SSIAFSRTVEDN KKTVQQPQQIES KVNIKKPSENEE CPVIKQVDENG NL | IDRCEICCNP ACFGCLN | IDR | CEICCNPA CFGC | LN | MKNLFIALMLLFSSI AFSRTVEDNKKTVQ QPQQIESKVNIKKPS ENEECPVIKQVDEN GNLIDRCEICCN PACFGCLN | RTVEDNKKT VQQPQQIESK VNIKKPSENE ECPVIKQVDE NGNLIDRCEI CCNPACFGCL N | MKNLFIALM LLFSSIAFSID RCEICCNPA CFGCLN |
| | | n/a | | ID | CCEICCNP ACFGC | LNDANG LINGDR PIRAQH VC | | | |

FIG. 4-3

METHODS AND COMPOSITIONS FOR THE TREATMENT OF HEART FAILURE AND OTHER DISORDERS

CLAIM OF PRIORITY

This application is the U.S. National Phase of PCT Application No. PCT/US2008/054972 filed Feb. 26, 2008, which claims priority, of U.S. Application No. 60/891,626, which was filed Feb. 26, 2007. Both of these applications are incorporated herein in their entirety.

TECHNICAL FIELD

This disclosure relates to methods and compositions for the treatment of heart failure, gastrointestinal disorders and other disorders.

SEQUENCE LISTING

This application incorporates by reference in its entirety the Sequence Listing entitled IW045PCT1US1-052113_ST25.txt (1,294 kilobytes) which was created May 21, 2013 and filed with the application on May 24, 2013.

BACKGROUND

Heart failure is a hemodynamic disorder resulting from impairment of the ability of the ventricle to fill with and/or eject blood. The disorder is commonly characterized by shortness of breath, fatigue, limited exercise tolerance, and fluid retention (both pulmonary congestion and peripheral edema). Heart failure is generally progressive and can result in Class IV heart failure (NYHA Heart Failure Classification) in which any physical activity brings on symptoms such as shortness of breath, and symptoms can occur even when the patient is at rest. Patients with symptoms of advanced heart failure are treated by tightly controlling fluid status and are often administered intravenous peripheral vasodilators and/or positive inotropic agents. Patients suffering Class IV heart failure should be at complete rest (confined to a bed or chair). Among the agents that are intravenously administered for treatment of advanced heart failure are dobutamine (beta receptor antagonist), milrinone (phosphodiesterase inhibitor), and nesiritide. Nesiritide is a cardiac derived peptide hormone (human natriuretic peptide B) that is thought to bind to and activate guanylate cyclase A (GC-A) receptor.

The guanylate cyclase-C (GC-C) receptor (reviewed by Lucas et al. 2000 Pharmacol. Rev 52:375-414 and Vaandrager et al. 2002 Molecular and Cellular Biochemistry 230:73-83) is a key regulator in mammals of intestinal function (although low levels of GC-C have been detected in other tissues). GC-C responds to the endogenous hormones, guanylin and uroguanylin, and to enteric bacterial peptides from the heat stable enterotoxin family (ST peptides). When agonists bind to GC-C, there is an elevation of the second messenger, cyclic GMP, and an increase in chloride and bicarbonate secretion, resulting in an increase in intestinal fluid secretion.

SUMMARY

Described herein are methods for treating other disorders such as congestive heart failure and benign prostatic hyperplasia by administering a peptide or small molecule (parenterally or orally) that acts as an agonist of the GC-C receptor. Such agents can be used in combination with natriuretic peptides (e.g., atrial natriuretic peptide, brain natriuretic peptide or C-type natriuretic peptide), a diuretic, or an inhibitor of angiotensin converting enzyme.

The peptides described herein can be used alone or in combination therapy to prevent and/or treat disorders associated with fluid and sodium retention, e.g., diseases of the electrolyte-water/electrolyte transport system within the kidney, gut and urogenital system, heart failure (e.g., congestive heart failure or acute heart failure), hypertension, salt dependent forms of high blood pressure, hepatic edema, and liver cirrhosis. In addition they can be used to facilitate diuresis or control intestinal fluid. The peptides and agonists described herein can also be used to treat disorders where there is abnormal proliferation of epithelial cells within the kidney (e.g. as in the case of renal cancer).

The peptides and agonists described herein can be used alone or in combination therapy to prevent and/or treat kidney disease. "Kidney disease" includes renal failure (including acute renal failure), renal insufficiency, nephrotic edema, glomerulonephritis, pyelonephritis, kidney failure, chronic renal failure, nephritis, nephrosis, azotemia, uremia, immune renal disease, acute nephritic syndrome, rapidly progressive nephritic syndrome, nephrotic syndrome, Berger's Disease, chronic nephritic/proteinuric syndrome, tubulointerstital disease, nephrotoxic disorders, renal infarction, atheroembolic renal disease, renal cortical necrosis, malignant nephroangiosclerosis, renal vein thrombosis, renal tubular acidosis, renal glucosuria, nephrogenic diabetes insipidus, Bartter's Syndrome, Liddle's Syndrome, polycystic kidney disease, medullary cystic disease, medullary sponge kidney, hereditary nephritis, and nail-patella syndrome, along with any disease or disorder that relates to the renal system and related disorders, as well as symptoms indicative of, or related to, renal or kidney disease and related disorders.

The peptides and agonists described herein can be used alone or in combination therapy to prevent or treat polycystic kidney disease. Polycystic kidney disease" "PKD" (also called "polycystic renal disease") refers to a group of disorders characterized by a large number of cysts distributed throughout dramatically enlarged kidneys. The resultant cyst development leads to impairment of kidney function and can eventually cause kidney failure. "PKD" specifically includes autosomal dominant polycystic kidney disease (ADPKD) and recessive autosomal recessive polycystic kidney disease (ARPKD), in all stages of development, regardless of the underlying cause.

The peptides and agonists described herein can be used for treating heart failure, including heart failure at any of stages I-IV according to New York Heart Association (NYHA) Functional Classification.

The peptides can also be used for treating IBS and other gastrointestinal disorders and conditions (e.g., gastrointestinal motility disorders, chronic intestinal pseudo-obstruction, colonic pseudo-obstruction, Crohn's disease, duodenogastric reflux, dyspepsia, functional dyspepsia, nonulcer dyspepsia, a functional gastrointestinal disorder, functional heartburn, gastroesophageal reflux disease (GERD), gastroparesis, irritable bowel syndrome (IBS, e.g., constipation predominant-IBS, diarrhea predominat-IBS, and/or alternating-IBS)), post-operative ileus, ulcerative colitis, chronic constipation, and disorders and conditions associated with constipation (e.g. constipation associated with use of opiate pain killers, post-surgical constipation, and constipation associated with neuropathic disorders as well as other conditions and disorders are described herein Without being bound by any particular theory, in the case of heart failure, salt retention, fluid retention disorders and combinations thereof the peptides are also useful because they may elicit one or more of diuresis, natriuresis and/or kaliuresis. Thus, the peptides described herein may be diuretics.

Without being bound by any particular theory, in the case of IBS and other gastrointestinal disorders the peptides are useful because they may increase gastrointestinal motility. The peptides may also decrease inflammation and may decrease gastrointestinal pain, visceral pain, chronic visceral hypersensitivity, or hypersensitivity to colorectal distension.

Described herein are pharmaceutical compositions comprising certain peptides that are capable of activating the guanylate-cyclase C (GC-C) receptor. Also described herein are pharmaceutical compositions comprising a peptide or GC-C agonist described herein and one or more additional therapeutic agents including, without limitation, the agents described herein. The other agents can be administered with the peptides described herein (simultaneously or sequentially). They can also be linked to a peptide described herein to create therapeutic conjugates.

Described herein are methods for treating various disorders by administering a peptide that acts as a partial or complete agonist of the GC-C receptor. In certain embodiments, the peptide includes at least six cysteines that can form three disulfide bonds. In certain embodiments the disulfide bonds are replaced by other covalent cross-links and in some cases the cysteines are substituted by other residues to provide for alternative covalent cross-links. The peptides may also include at least one trypsin or chymotrypsin cleavage site and/or an amino or carboxy-terminal analgesic peptide or small molecule, e.g., AspPhe or some other analgesic peptide. When present within the peptide, the analgesic peptide or small molecule may be preceded by a chymotrypsin or trypsin cleavage site that allows release of the analgesic peptide or small molecule. Certain peptides include a functional chymotrypsin or trypsin cleavage site located so as to allow inactivation of the peptide upon cleavage. Certain peptides having a functional cleavage site undergo cleavage and gradual inactivation in the digestive tract, and this is desirable in some circumstances. In certain peptides, a functional chymotrypsin site is altered, increasing the stability of the peptide in vivo.

The methods described herein include a method for increasing intestinal motility comprising administering a GC-C receptor agonist, e.g., a peptide described herein, to a patient in need thereof; a method for treating a disorder associated with reduced gastrointestinal transit rates or reduced gastrointestinal motility comprising administering a GC-C receptor agonist, e.g., a peptide described herein, to a patient in need thereof; a method for treating a gastrointestinal hypomotility disorder comprising administering a GC-C receptor agonist, e.g., a peptide described herein, to a patient in need thereof; a method for treating a non-inflammatory gastrointestinal disorder comprising administering a GC-C receptor agonist, e.g., a peptide described herein, to a patient in need thereof; a method for treating a gastrointestinal disorder other than Crohn's disease and ulcerative colitis comprising administering a GC-C receptor agonist to a patient in need thereof; and methods and compositions for increasing intestinal motility comprising administering a GC-C receptor agonist to a patient in need thereof. The disorders which can be treated by administering a GC-C receptor agonist include, for example, constipation, constipation dominant irritable bowel syndrome and pelvic floor dyssynergia. In certain embodiments the patient has been diagnosed as suffering from IBS according to the Rome criteria. In certain embodiments the patient is female.

In certain embodiments the peptides include either one or two or more contiguous negatively charged amino acids (e.g., Asp or Glu) or one or two or more contiguous positively charged residues (e.g., Lys or Arg) or one or two or more contiguous positively or negatively charged amino acids at the carboxy terminus. In these embodiments all of the flanking amino acids at the carboxy terminus are either positively or negatively charged. In other embodiments the carboxy terminal charged amino acids are preceded by a Leu. For example, any of the following amino acid sequences can be added to the carboxy terminus of the peptide: Asp; Asp Lys; Lys Lys Lys Lys Lys Lys; Asp Lys Lys Lys Lys Lys Lys; Leu Lys Lys; and Leu Asp. It is also possible to simply add Leu at the carboxy terminus.

Described herein is a peptide or a pharmaceutically acceptable salt thereof comprising the amino acid sequence:

$Xaa_1$ $Xaa_2$ $Xaa_3$ Cys Glu $Xaa_6$ $Xaa_7$ Cys $Xaa_9$ Pro Ala Cys Thr Gly $Xaa_{15}$ $Xaa_{16}$ (SEQ ID NO:7) or a pharmaceutically acceptable salt thereof, wherein
$Xaa_1$ is any amino acid or is missing;
$Xaa_2$ is Ala, Gly, Lys, Ser, Val or is missing;
$Xaa_3$ is Cys or D-Cys;
$Xaa_6$ is any amino acid;
$Xaa_7$ is Cys or D-Cys;
$Xaa_9$ is Asn or Thr;
$Xaa_{15}$ is Cys or D-Cys;
$Xaa_{16}$ is Lys, Tyr or is missing;
provided that:
(a) one or more of $Xaa_3$, $Xaa_7$ and $Xaa_{15}$ is D-Cys when $Xaa_{16}$ is other than Lys; and
(b) the peptide does not consist of the sequence D-Cys Cys Glu Leu Cys Cys Asn Pro Ala Cys Thr Gly Cys (SEQ ID NO:33).

In various embodiments: $Xaa_3$ is D-Cys; $Xaa_7$ is D-Cys; $Xaa_{15}$ is D-Cys; $Xaa_3$ is D-Cys; $Xaa_7$ is Cys; $Xaa_{15}$ is D-Cys; $Xaa_6$ is Val, Ile, Leu Tyr, Phe, or Trp; $Xaa_6$ is Val, Ile, or Leu; $Xaa_6$ is Val; $Xaa_6$ is Ile; $Xaa_6$ is Leu; $Xaa_6$ is Tyr, Phe, Trp; $Xaa_1$ is any amino acid; $Xaa_1$ is Gly or Ala; $Xaa_1$ is Gly; $Xaa_1$ is Ala; $Xaa_1$ is missing; $Xaa_6$ is Tyr; $Xaa_6$ is Phe; $Xaa_6$ is Trp; at least one of $Xaa_3$, $Xaa_7$ and $Xaa_{15}$ is D-Cys; at least two of $Xaa_3$, $Xaa_7$ and $Xaa_{15}$ are D-Cys; $Xaa_3$, $Xaa_7$ and $Xaa_{15}$ are all D-Cys; $Xaa_9$ is Asn; $Xaa_9$ is Thr; $Xaa_{16}$ is Lys; $Xaa_{16}$ is Tyr; $Xaa_{16}$ is missing; the peptide is a peptide in any of FIGS. 3a and 3b; and the peptide is purified.

Also described is a pharmaceutical composition comprising any of the aforementioned peptides and a pharmaceutically acceptable carrier.

Also described is a method for reducing fluid retention, the method comprising administering the pharmaceutical composition comprising any of the aforementioned peptides and a pharmaceutically acceptable carrier or a pharmaceutical composition comprising a peptide consisting of the amino acid sequence D-Cys Cys Glu Leu Cys Cys Asn Pro Ala Cys Thr Gly Cys (SEQ ID NO:33).

Also described is a method of treating a disorder selected from: heart failure, hypertension, salt dependent forms of high blood pressure, hepatic edema, or liver cirrhosis comprising administering a pharmaceutical composition comprising any of the aforementioned peptides and a pharmaceutically acceptable carrier or a pharmaceutical composition comprising a peptide consisting of the amino acid sequence D-Cys Cys Glu Leu Cys Cys Asn Pro Ala Cys Thr Gly Cys (SEQ ID NO:33).

The peptides can be used to treat chronic or acute heart failure. In acute heart failure the patient appears to be in good health, but suddenly develops a large myocardial infarction or rupture of a cardiac valve. The acute heart failure is usually largely systolic and the sudden reduction in cardiac output often results in systemic hypotension without peripheral edema. Chronic heart failure is typically observed in patients with dilated cardiomyopathy or multivalvular heart disease that develops or progresses slowly. In chronic heart failure, arterial pressure tends to be well maintained until very late in the course, but there is often accumulation of peripheral edema.

Also described is a method for increasing naturesis comprising administering the pharmaceutical composition comprising any of the aforementioned peptides and a pharmaceutically acceptable carrier or a pharmaceutical composition comprising a peptide consisting of the amino acid sequence D-Cys Cys Glu Leu Cys Cys Asn Pro Ala Cys Thr Gly Cys (SEQ ID NO:33).

Also described is a method for increasing diuresis comprising administering the pharmaceutical composition comprising any of the aforementioned peptides and a pharmaceutically acceptable carrier or a pharmaceutical composition comprising a peptide consisting of the amino acid sequence D-Cys Cys Glu Leu Cys Cys Asn Pro Ala Cys Thr Gly Cys (SEQ ID NO:33).

Also described is a method of treating a gastrointestinal disorder comprising administering the pharmaceutical composition comprising any of the aforementioned peptides and a pharmaceutically acceptable carrier or a pharmaceutical composition comprising a peptide consisting of the amino acid sequence D-Cys Cys Glu Leu Cys Cys Asn Pro Ala Cys Thr Gly Cys (SEQ ID NO:33).

In various embodiments the gastrointestinal disorder is selected from: a gastrointestinal motility disorder, chronic intestinal pseudo-obstruction, colonic pseudo-obstruction, Crohn's disease, duodenogastric reflux, dyspepsia, functional dyspepsia, nonulcer dyspepsia, a functional gastrointestinal disorder, functional heartburn, gastroesophageal reflux disease (GERD), gastroparesis, irritable bowel syndrome, post-operative ileus, inflammatory bowel disorder, ulcerative colitis, constipation, chronic constipation, chronic idiopathic constipation.

Also described is a method for treating obesity comprising administering the pharmaceutical composition comprising any of the aforementioned peptides and a pharmaceutically acceptable carrier or a pharmaceutical composition comprising a peptide consisting of the amino acid sequence D-Cys Cys Glu Leu Cys Cys Asn Pro Ala Cys Thr Gly Cys (SEQ ID NO:33).

Also described is a method for treating benign prostatic hyperplasia comprising administering the pharmaceutical composition comprising any of the aforementioned peptides and a pharmaceutically acceptable carrier or a pharmaceutical composition comprising a peptide consisting of the amino acid sequence D-Cys Cys Glu Leu Cys Cys Asn Pro Ala Cys Thr Gly Cys (SEQ ID NO:33).

Also described is a method for treating constipation comprising administering the pharmaceutical composition comprising any of the aforementioned peptides and a pharmaceutically acceptable carrier or a pharmaceutical composition comprising a peptide consisting of the amino acid sequence D-Cys Cys Glu Leu Cys Cys Asn Pro Ala Cys Thr Gly Cys (SEQ ID NO:33).

In various embodiments: the constipation is idiopathic constipation; the constipation is chronic idiopathic constipation; the gastrointestinal disorder is irritable bowel syndrome; the irritable bowel syndrome is diarrhea-predominant irritable bowel syndrome; the irritable bowel syndrome is constipation-predominant irritable bowel syndrome; the irritable bowel syndrome is alternating-irritable bowel syndrome; the gastrointestinal disorder is inflammatory bowel disorder; the gastrointestinal disorder is Crohn's disease; and the gastrointestinal disorder is ulcerative colitis.

Also described is a method for increasing gastrointestinal motility comprising administering the pharmaceutical composition comprising any of the aforementioned peptides and a pharmaceutically acceptable carrier or a pharmaceutical composition comprising a peptide consisting of the amino acid sequence D-Cys Cys Glu Leu Cys Cys Asn Pro Ala Cys Thr Gly Cys (SEQ ID NO:33).

Also described is a method for decreasing gastrointestinal pain or visceral pain comprising administering the pharmaceutical composition comprising any of the aforementioned peptides and a pharmaceutically acceptable carrier or a pharmaceutical composition comprising a peptide consisting of the amino acid sequence D-Cys Cys Glu Leu Cys Cys Asn Pro Ala Cys Thr Gly Cys (SEQ ID NO:33).

Also described is a method of preventing or treating a side-effect associated with opioid administration, the method comprising administering to a patient that is being treated with an opioid a pharmaceutical composition comprising any of the aforementioned peptides and a pharmaceutically acceptable carrier or a pharmaceutical composition comprising a peptide consisting of the amino acid sequence D-Cys Cys Glu Leu Cys Cys Asn Pro Ala Cys Thr Gly Cys (SEQ ID NO:33). In various embodiments: the patient is being treated with an opioid selected from the group consisting of alfentanil, buprenorphine, butorphanol, codeine, dezocine, dihydrocodeine, fentanyl, hydrocodone, hydromorphone, levorphanol, meperidine (pethidine), methadone, morphine, nalbuphine, oxycodone, oxymorphone, pentazocine, propiram, propoxyphene, sufentanil and tramadol; the patient is being treated with an opioid selected from the group consisting of: morphine, codeine, oxycodone, hydrocodone, dihydrocodeine, propoxyphene, fentanyl and tramadol; the side effect is selected from the group consisting of constipation, nausea and vomiting; and the method further comprises administering an opioid antagonist (e.g., naloxone or naltrexone).

Also described is a pharmaceutical composition comprising an opioid and any forgoing peptide or a peptide consisting of the amino acid sequence D-Cys Cys Glu Leu Cys Cys Asn Pro Ala Cys Thr Gly Cys (SEQ ID NO:33). In various embodiments: the opioid is selected from the group consisting of alfentanil, buprenorphine, butorphanol, codeine, dezocine, dihydrocodeine, fentanyl, hydrocodone, hydromorphone, levorphanol, meperidine (pethidine), methadone, morphine, nalbuphine, oxycodone, oxymorphone, pentazocine, propiram, propoxyphene, sufentanil and tramadol; and the opioid is selected from the group consisting of morphine, codeine, oxycodone, hydrocodone, dihydrocodeine, propoxyphene, fentanyl and tramadol.

Also described is a pharmaceutical kit comprising:
(a) a first container containing pharmaceutical dosage units comprising an effective amount of an opioid; and
(b) a second container containing pharmaceutical dosage units comprising an effective amount of a forgoing peptide or a peptide consisting of the amino acid sequence D-Cys Cys Glu Leu Cys Cys Asn Pro Ala Cys Thr Gly Cys (SEQ ID NO:33). In various embodiments: the opioid is selected from the group consisting of alfentanil, buprenorphine, butorphanol, codeine, dezocine, dihydrocodeine, fentanyl, hydrocodone, hydromorphone, levorphanol, meperidine (pethidine), methadone, morphine, nalbuphine, oxycodone, oxymorphone, pentazocine, propiram, propoxyphene, sufentanil and tramadol; and the opioid is selected from the group consisting of: morphine, codeine, oxycodone, hydrocodone, dihydrocodeine, propoxyphene, fentanyl and tramadol.

Also described is a method for preparing a pharmaceutical composition comprising admixing a forgoing peptide and a pharmaceutically acceptable carrier.

Also described herein are purified peptides comprising, consisting of, or consisting essentially of the amino acid sequence of SEQ ID NO: 7 and those peptides depictured in FIG. 3a and FIG. 3b (SEQ ID NOs: 60-3511 and SEQ ID NOs: 1-6).

Also described herein are pharmaceutical compositions comprising peptides comprising, consisting of, or consisting essentially of the amino acid sequence of SEQ ID NO:7 and those peptides depicted in FIG. 3a and FIG. 3b (SEQ ID NOs: 60-3511 and SEQ ID NOs: 1-6).

In certain embodiments, for example, when fully folded, the peptide includes disulfide bonds between $Cys_3$ and $Cys_8$, between $Cys_4$ and $Cys_{12}$ and between $Cys_7$ and $Cys_{15}$. In other embodiments, the peptide is a reduced peptide having no disulfide bonds. In still other embodiments the peptide has one or two disulfide bonds chosen from: a disulfide bond between $Cys_3$ and $Cys_8$, a disulfide bond between $Cys_4$ and $Cys_{12}$ and a disulfide bond between $Cys_7$ and $Cys_{15}$. In other embodiments, one or more of $Cys_3$, $Cys_7$, or $Cys_{15}$ is a D-Cys residue and the D-Cys residues can form disulfide bonds in the same manner as the Cys residues. Thus, the peptide may include, for example, one or more disulfide bonds between D-$Cys_3$ and $Cys_8$, between $Cys_4$ and $Cys_{12}$, between D-$Cys_7$ and $Cys_{15}$, between $Cys_7$ and D-$Cys_{15}$, between D-$Cys_7$ and D-$Cys_{15}$.

In some embodiments the peptide is 13, 14, 15, or 16 amino acids long.

In certain embodiments, one or more amino acids can be replaced by a non-naturally occurring amino acid or a naturally or non-naturally occurring amino acid analog. In certain embodiments, one or more L-amino acids can be substituted with a D-amino acid. There are many amino acids beyond the standard 20 amino acids (Ala, Arg, Asn, Asp, Cys, Gln, Glu, Gly, His, Ile, Leu, Lys, Met, Phe, Pro, Ser, Thr, Trp, Tyr, and Val). Some are naturally-occurring others are not (see, for example, Hunt, The Non-Protein Amino Acids: In Chemistry and Biochemistry of the Amino Acids, Barrett, Chapman and Hall, 1985). For example, an aromatic amino acid can be replaced by 3,4-dihydroxy-L-phenylalanine, 3-iodo-L-tyrosine, triiodothyronine, L-thyroxine, phenylglycine (Phg) or nor-tyrosine (norTyr). Phg and norTyr and other amino acids including Phe and Tyr can be substituted by, e.g., a halogen, —CH3, —OH, —CH$_2$NH$_3$, —C(O)H, —CH$_2$CH$_3$, —CN, —CH$_2$CH$_2$CH$_3$, —SH, or another group. Any amino acid can be substituted by the D-form of the amino acid. Thus, for example, a cysteine residue can be substituted by a D-cysteine residue.

With regard to non-naturally occurring amino acids or naturally and non-naturally occurring amino acid analogs, a number of substitutions in the peptide of SEQ ID NO:7 or the peptides of FIG. 3a and FIG. 3b (SEQ ID NOs: 60-3511 and SEQ ID NOs: 1-6) are possible alone or in combination.

Glu can be replaced by gamma-Hydroxy-Glu or gamma-Carboxy-Glu.

Ala can be replaced by an alpha substituted amino acid such as L-alpha-methylphenylalanine or by analogues such as: 3-Amino-Tyr; Tyr(CH$_3$); Tyr(PO$_3$(CH$_3$)$_2$); Tyr(SO$_3$H); beta-Cyclohexyl-Ala; beta-(1-Cyclopentenyl)-Ala; beta-Cyclopentyl-Ala; beta-Cyclopropyl-Ala; beta-Quinolyl-Ala; beta-(2-Thiazolyl)-Ala; beta-(Triazole-1-yl)-Ala; beta-(2-Pyridyl)-Ala; beta-(3-Pyridyl)-Ala; Amino-Phe; Fluoro-Phe; Cyclohexyl-Gly; tBu-Gly; beta-(3-benzothienyl)-Ala; beta-(2-thienyl)-Ala; 5-Methyl-Trp; and 4-Methyl-Trp.

Pro can be an N(alpha)-C(alpha) cyclized amino acid analogues with the structure:

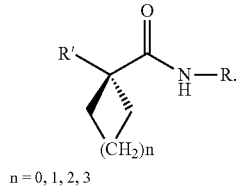

n = 0, 1, 2, 3

Pro can also be homopro (L-pipecolic acid); hydroxy-Pro; 3,4-Dehydro-Pro; 4-fluoro-Pro; or alpha-methyl-Pro.

Val or Leu can also be an alpha-substituted or N-methylated amino acid such as alpha-amino isobutyric acid (aib), L/D-alpha-ethylalanine (L/D-isovaline), L/D-methylvaline, or L/D-alpha-methylleucine or a non-natural amino acid such as beta-fluoro-Ala.

Gly can be alpha-amino isobutyric acid (aib) or L/D-alpha-ethylalanine (L/D-isovaline).

Further examples of unnatural amino acids include: an unnatural analogue of tyrosine; an unnatural analogue of glutamine; an unnatural analogue of phenylalanine; an unnatural analogue of serine; an unnatural analogue of threonine; an alkyl, aryl, acyl, azido, cyano, halo, hydrazine, hydrazide, hydroxyl, alkenyl, alkynl, ether, thiol, sulfonyl, seleno, ester, thioacid, borate, boronate, phospho, phosphono, phosphine, heterocyclic, enone, imine, aldehyde, hydroxylamine, keto, or amino substituted amino acid, or any combination thereof; an amino acid with a photoactivatable cross-linker; a spin-labeled amino acid; a fluorescent amino acid; an amino acid with a novel functional group; an amino acid that covalently or noncovalently interacts with another molecule; a metal binding amino acid; an amino acid that is amidated at a site that is not naturally amidated, a metal-containing amino acid; a radioactive amino acid; a photo-caged and/or photoisomerizable amino acid; a biotin or biotin-analogue containing amino acid; a glycosylated or carbohydrate modified amino acid; a keto containing amino acid; amino acids comprising polyethylene glycol or poly-ether; a heavy atom substituted amino acid (e.g., an amino acid containing deuterium, tritium, $^{13}$C, $^{15}$N, or $^{18}$O); a chemically cleavable or photocleavable amino acid; an amino acid with an elongated side chain; an amino acid containing a toxic group; a sugar substituted amino acid, e.g., a sugar substituted serine or the like; a carbon-linked sugar-containing amino acid; a redox-active amino acid; an α.-hydroxy containing acid; an amino thio acid containing amino acid; an α, α disubstituted amino acid; a β-amino acid; a cyclic amino acid other than proline; an O-methyl-L-tyrosine; an L-3-(2-naphthyl)alanine; a 3-methyl-phenylalanine; a p-acetyl-L-phenylalanine; an 0-4-allyl-L-tyrosine; a 4-propyl-L-tyrosine; a tri-O-acetyl-GlcNAcβ-serine; an L-Dopa; a fluorinated phenylalanine; an isopropyl-L-phenylalanine; a p-azido-L-phenylalanine; a p-acyl-L-phenylalanine; a p-benzoyl-L-phenylalanine; an L-phosphoserine; a phosphonoserine; a phosphonotyrosine; a p-iodo-phenylalanine; a 4-fluorophenylglycine; a p-bromophenylalanine; a p-amino-L-phenylalanine; an isopropyl-L-phenylalanine; L-3-(2-naphthyl)alanine; an amino-, isopropyl-, or O-allyl-containing phenylalanine analogue; a dopa, O-methyl-L-tyrosine; a glycosylated amino acid; a p-(propargyloxy)phenylalanine; dimethyl-Lysine; hydroxy-proline; mercaptopropionic acid;

methyl-lysine; 3-nitro-tyrosine; norleucine; pyro-glutamic acid; Z (Carbobenzoxyl); ε-Acetyl-Lysine; β-alanine; aminobenzoyl derivative; aminobutyric acid (Abu); citrulline; aminohexanoic acid; aminoisobutyric acid; cyclohexylalanine; d-cyclohexylalanine; hydroxyproline; nitro-arginine; nitro-phenylalanine; nitro-tyrosine; norvaline; octahydroindole carboxylate; ornithine; penicillamine; tetrahydroisoquinoline; acetamidomethyl protected amino acids and pegylated amino acids. Further examples of unnatural amino acids and amino acid analogs can be found in U.S. 20030108885, U.S. 20030082575, US20060019347 (paragraphs 410-418) and the references cited therein. The peptides described herein can include further modifications including those described in US20060019347, paragraph 589.

In some embodiments, an amino acid can be replaced by a naturally-occurring, non-essential amino acid, e.g., taurine.

Methods to manufacture peptides containing unnatural amino acids can be found in, for example, US20030108885, US20030082575, US20060019347, Deiters et al., J Am Chem. Soc. (2003) 125:11782-3, Chin et al., Science (2003) 301:964-7, and the references cited therein.

Peptides that include non-natural amino acids can also be prepared using the methods described in WO02086075.

The peptides described herein can have one or more conventional peptide bonds replaced by an alternative bond. Such replacements can increase the stability of the peptide. For example, replacement of the peptide bond between D-$Cys_{15}$ or $Cys_{15}$ and $Xaa_{16}$ with an alternative bond can reduce cleavage by carboxy peptidases and may increase half-life in the digestive tract. Bonds that can replace peptide bonds include: a retro-inverso bonds (C(O)—NH instead of NH—C(O); a reduced amide bond (NH—CH$_2$); a thiomethylene bond (S—CH$_2$ or CH$_2$—S); an oxomethylene bond (O—CH$_2$ or CH$_2$—O); an ethylene bond (CH$_2$—CH$_2$); a thioamide bond (C(S)—NH); a trans-olefine bond (CH=CH); an fluoro substituted trans-olefine bond (CF=CH); a ketomethylene bond (C(O)—CHR or CHR—C(O) wherein R is H or CH$_3$; and a fluoro-ketomethylene bond (C(O)—CFR or CFR—C(O) wherein R is H or F or CH$_3$.

The peptides described herein can be modified using standard modifications. Modifications may occur at the amino (N—), carboxy (C—) terminus, internally or a combination of any of the preceeding. In one aspect described herein, there may be more than one type of modification of the peptide. Modifications include but are not limited to: acetylation, amidation, biotinylation, cinnamoylation, farnesylation, formylation, myristoylation, palmitoylation, phosphorylation (Ser, Tyr or Thr), stearoylation, succinylation, sulfurylation and cyclisation (via disulfide bridges or amide cyclisation), and modification by Cy3 or Cy5. The peptides described herein may also be modified by 2,4-dinitrophenyl (DNP), DNP-lysin, modification by 7-Amino-4-methyl-coumarin (AMC), flourescein, NBD (7-Nitrobenz-2-Oxa-1,3-Diazole), p-nitroanilide, rhodamine B, EDANS (5-((2-aminoethyl)amino) naphthalene-1-sulfonic acid), dabcyl, dabsyl, dansyl, Texas Red, FMOC, and Tamra (Tetramethylrhodamine). The peptides described herein may also be conjugated to, for example, polyethylene glycol (PEG); alkyl groups (e.g., C1-C20 straight or branched alkyl groups); fatty acid radicals; combinations of PEG, alkyl groups and fatty acid radicals (see U.S. Pat. No. 6,309,633; Soltero et al., 2001 Innovations in Pharmaceutical Technology 106-110); BSA and KLH (Keyhole Limpet Hemocyanin). The addition of PEG and other polymers which can be used to modify peptides described herein is described in US2006019347 section IX.

The peptides and agonists described herein can be chemically modified to increase therapeutic activity by synthetically adding sugar moieties (WO 88/02756; WO 89/09786; DE 3910667 A1, EP 0 374 089 A2; and U.S. Pat. No. 4,861,755), adding cationic anchors (EP0363589), lipid moieties (WO91/09837; U.S. Pat. No. 4,837,303) or the substituents described as compounds I, II, and III in U.S. Pat. No. 5,552,520.

The peptides described herein bear some sequence similarity to ST peptides. However, they include amino acid changes and/or additions that improve functionality. These changes can, for example, increase or decrease activity (e.g., increase or decrease the ability of the peptide to stimulate intestinal motility), alter the ability of the peptide to fold correctly, alter the stability of the peptide, alter the ability of the peptide to bind the GC-C receptor and/or decrease toxicity. In some cases the peptides may function more desirably than wild-type ST peptide. For example, they may limit undesirable side effects such as diarrhea and dehydration.

In some embodiments one or both members of one or more pairs of Cys residues (including where a Cys residue has been substituted with a D-cys residue) which normally form a disulfide bond can be replaced by homocysteine, penicillamine, 3-mercaptoproline (Kolodziej et al. 1996 Int J Pept Protein Res 48:274); β, β dimethylcysteine (Hunt et al. 1993 hit J Pept Protein Res 42:249) or diaminopropionic acid (Smith et al. 1978 J Med Chem 21:117) to form alternative internal cross-links at the positions of the normal disulfide bonds.

In addition, one or more disulfide bonds can be replaced by alternative covalent cross-links, e.g., an amide linkage (—CH$_2$CH(O)NHCH$_2$— or —CH$_2$NHCH(O)CH$_2$—), an ester linkage, a thioester linkage, a lactam bridge, a carbamoyl linkage, a urea linkage, a thiourea linkage, a phosphonate ester linkage, an alkyl linkage (—CH$_2$CH$_2$CH$_2$CH$_2$—), an alkenyl linkage(—CH$_2$CH=CHCH$_2$—), an ether linkage (—CH$_2$CH$_2$OCH$_2$— or —CH$_2$OCH$_2$CH$_2$—), a thioether linkage (—CH$_2$CH$_2$SCH$_2$— or —CH$_2$SCH$_2$CH$_2$—), an amine linkage (—CH$_2$CH$_2$NHCH$_2$— or —CH$_2$NHCH$_2$CH$_2$—) or a thioamide linkage (—CH$_2$CH(S)HNHCH$_2$— or —CH$_2$NHCH(S)CH$_2$—). For example, Ledu et al. (Proc Nat'l Acad. Sci. 100:11263-78, 2003) describe methods for preparing lactam and amide cross-links. Schafineister et al. (J. Am. Chem. Soc. 122:5891, 2000) describes stable, hydrocarbon cross-links. Hydrocarbon cross links can be produced via metathesis (or methathesis followed by hydrogenation in the case of saturated hydrocarbons cross-links) using one or another of the Grubbs catalysts (available from Materia, Inc. and Sigma-Aldrich and described, for example, in U.S. Pat. Nos. 5,831,108 and 6,111,121). In some cases, the generation of such alternative cross-links requires replacing the Cys residues with other residues such as Lys or Glu or non-naturally occurring amino acids. In addition the lactam, amide and hydrocarbon cross-links can be used to stabilize the peptide even if they link amino acids at positions other than those occupied by Cys. Such cross-links can occur between two amino acids that are separated by two amino acids or between two amino acids that are separated by six amino acids (see, e.g., Schafineister et al. (J. Am. Chem. Soc. 122:5891, 2000)).

The peptide may contain additional carboxyterminal or amino terminal amino acids or both. For example, the peptide can include an amino terminal sequence that facilitates recombinant production of the peptide and is cleaved prior to administration of the peptide to a patient. The peptide can also include other amino terminal or carboxyterminal amino acids. In some cases the additional amino acids protect the peptide, stabilize the peptide or alter the activity of the peptide. In some cases some or all of these additional amino acids are removed prior to administration of the peptide to a patient. The peptide can include 1, 2, 3, 4, 5, 10, 15, 20, 25, 30, 40, 50, 60, 70 80, 90, 100 or more amino acids at its amino terminus or carboxy terminus or both. The number of flanking amino acids need not be the same. For example, there can be 10 additional amino acids at the amino terminus of the peptide and none at the carboxy terminus.

The peptides can be co-administered with or linked, e.g., covalently linked to any of a variety of other peptides or compounds including analgesic peptides or analgesic compounds including, without limitation, the agents described herein.

Amino acid, non-amino acid, peptide and non-peptide spacers can be interposed between a peptide that is a GC-C receptor agonist and a peptide that has some other biological function, e.g., an analgesic peptide or a peptide used to treat obesity. The linker can be one that is cleaved from the flanking peptides in vivo or one that remains linked to the flanking peptides in vivo. For example, glycine, beta-alanine, glycyl-glycine, glycyl-beta-alanine, gamma-aminobutyric acid, 6-aminocaproic acid, L-phenylalanine, L-tryptophan and glycil-L-valil-L-phenylalanine can be used as spacers (Chaltin et al. 2003 Helvetica Chimica Acta 86:533-547; Caliceti et al. 1993 FARMCO 48:919-32) as can polyethylene glycols (Butterworth et al. 1987 J. Med. Chem. 30:1295-302) and maleimide derivatives (King et al. 2002 Tetrahedron Lett. 43:1987-1990). Various other linkers are described in the literature (Nestler 1996 Molecular Diversity 2:35-42; Finn et al. 1984 Biochemistry 23:2554-8; Cook et al. 1994 Tetrahedron Lett. 35:6777-80; Brokx et al. 2002 Journal of Controlled Release 78:115-123; Griffin et al. 2003 J. Am. Chem. Soc. 125:6517-6531; Robinson et al. 1998 Proc. Natl. Acad. Sci. USA 95:5929-5934). Linkers are also described in US20050171014, for example, amino acid linkers such as FALA, VLALA, ALAL, ALALA, 2-cyclohexyl-L-alanine-LALA, 2-cyclohexyl-L-alanine-2-cyclohexyl-L-alanine-LAL, 1-naphtyl-alanine-ChaLAL and 1-naphtyl-alanine-LALA. Peptides and agonists described herein can also be conjugated to: an affinity tag (such as (histidine 6) H6), a HIV tat peptide residues 49-57, HIV tat peptide residues 49-56, the tat sequence YGRKKRRQRRR (SEQ ID NO:34), a polyarginine peptide having from 6 to 20 residues (such as R6) and the following peptide sequences: YARKARRQARR (SEQ ID NO:35), YARAAARQARA (SEQ ID NO:36), YARAAR-RAARR (SEQ ID NO:37) YARAARRAARA (SEQ ID NO:38), ARRRRRRRRR (SEQ ID NO:39), and YAAAR-RRRRRR (SEQ ID NO:40), which are disclosed in WO 99/29721 and in U.S. Pat. No. 6,221,355.

The peptides described herein can be attached to one, two or more different moieties each providing the same or different functions. For example, the peptide can be linked to a molecule that is an analgesic and to a peptide that is used to treat obesity. The peptide and various moieties can be ordered in various ways. For example, a peptide described herein can have an analgesic peptide linked to its amino terminus and an anti-obesity peptide linked to its carboxy terminus. The additional moieties can be directly covalently bonded to the peptide or can be bonded via linkers.

The peptides described herein can be a cyclic peptide or a linear peptide. In addition, multiple copies of the same peptide can be incorporated into a single cyclic or linear peptide.

The peptides can include the amino acid sequence of a peptide that occurs naturally in a vertebrate (e.g., mammalian) species or in a bacterial species. In addition, the peptides can be partially or completely non-naturally occurring peptides. Also within the disclosure are peptidomimetics corresponding to the peptides described herein.

Described herein is a method for treating congestive heart failure, the method comprising administering to a patient a pharmaceutical composition comprising a purified peptide comprising, consisting of or consisting essentially of the amino acid sequence of SEQ ID NO:7 (e.g., a peptide in FIG. 3a or FIG. 3b; (SEQ ID NOs: 60-3511 and SEQ ID NOs: 1-6)). The peptide can be administered alone or in combination with another agent for treatment of congestive heart failure, for example, a natriuretic peptide such as atrial natriuretic peptide, brain natriuretic peptide or C-type natriuretic peptide, an inhibitor of angiotensin converting enzyme, a diuretic (e.g. furesomide (Lasix), bumetanide (Bumex), ethacrynic acid (Edecrin), torsemide (Demadex), amiloride (Midamor), spironolactone (Aldactone), chorthiazide (Diuril), metolazone (Zaroxylyn)), an Angiotension-Converting Enzyme (ACE) inhibitor (e.g. captopril (Capoten), enalopril (Vasotec), lisinopril (Prinivil, Zestril), ramipril (Altace)), a Beta blocker (e.g. carvedilol (Coreg) or an inotropes (e.g. digoxin, dobutaimine, dopamine Milrinone). In various embodiments the congestive heart failure is categorized as Class II congestive heart failure; the congestive heart failure is categorized as Class III congestive heart failure; and the congestive heart failure is categorized as Class W congestive heart failure. The New York Heart Association (NYHA) functional classification system relates congestive heart failure symptoms to everyday activities and the patient's quality of life. The NYHA defines the classes of patient symptoms relating to congestive heart failure as: Class II-slight limitation of physical activity, comfortable at rest, but ordinary physical activity results in fatigue, palpitation, or dyspnea; Class III-marked limitation of physical activity, comfortable at rest, but less than ordinary activity causes fatigue, palpitation, or dyspnea and Class IV-unable to carry out any physical activity without discomfort, symptoms of cardiac insufficiency at rest, if any physical activity is undertaken, discomfort is increased. Heart failure treatment using the peptides and methods described herein can also be classified according to the ACC/AHA guidelines (Stage A: At risk for developing heart failure without evidence of cardiac dysfunction; Stage B: Evidence of cardiac dysfunction without symptoms; Stage C: Evidence of cardiac dysfunction with symptoms; and Stage D: Symptoms of heart failure despite maximal therapy).

Described herein is a method for treating a gastrointestinal disorder, the method comprising administering a peptide comprising, consisting essentially of or consisting of the amino acid sequence of SEQ ID NO:7, e.g., a peptide in FIG. 3a or FIG. 3b (SEQ ID NOs: 60-3511 and SEQ ID NOs: 1-6)). In various embodiments: the patient is suffering from a disorder selected from the group consisting of gastrointestinal motility disorders, chronic intestinal pseudo-obstruction, colonic pseudo-obstruction, Crohn's disease, duodenogastric reflux, dyspepsia, functional dyspepsia, nonulcer dyspepsia, a functional gastrointestinal disorder, functional heartburn, gastroesophageal reflux disease (GERD), gastroparesis, irritable bowel syndrome, post-operative ileus, ulcerative colitis, chronic constipation, and disorders and conditions associated with constipation (e.g. constipation associated with use of opiate pain killers, post-surgical constipation, and constipation associated with neuropathic disorders as well as other conditions and disorders are described herein); the patient is suffering from a gastrointestinal motility disorder, chronic intestinal pseudo-obstruction, colonic pseudo-obstruction, Crohn's disease, duodenogastric reflux, dyspepsia, functional dyspepsia, nonulcer dyspepsia, a functional gastrointestinal disorder, functional heartburn, gastroesophageal reflux disease (GERD), gastroparesis, inflammatory bowel disease, irritable bowel syndrome (e.g. d-IBS, c-IBS, and/or a-IBS), post-operative ileus, ulcerative colitis, chronic constipation, and disorders and conditions associated with constipation (e.g. constipation associated with use of opiate pain killers, post-surgical constipation, and constipation associated with neuropathic disorders as well as other conditions and disorders are described herein); the patient has been diagnosed with a functional gastrointestinal disorder according to the Rome Criteria (e.g. Rome II), the patient has been diagnosed with irritable bowel syndrome (e.g. (e.g. diarrhea predominant-IBS, constipation predominant-IBS, and/or alternating-IBS), according to the Rome Criteria (e.g. Rome II); the composition is administered orally; the peptide comprises 30 or fewer amino acids, the peptide comprises 20 or fewer amino acids, the peptide comprises no more than 5 amino acids prior to $Cys_6$; the peptide comprises 14 amino acids, the peptide comprises 13 amino acids; the peptide comprises 150, 140, 130, 120, 110, 100, 90, 80, 70, 60, 50, 40, or 30 or fewer amino acids. In other embodiments, the peptide comprises 20 or fewer amino acids. In other embodiments the peptide comprises no more than 20, 15, 10, or 5 peptides subsequent to $Cys_{18}$. In certain embodiments $Xaa_{19}$ is a chymotrypsin or trypsin cleavage site and an analgesic peptide is present immediately following $Xaa_{19}$.

Described herein is a method for treating a patient suffering from constipation. Clinically accepted criteria that define constipation include the frequency of bowel movements, the consistency of feces and the ease of bowel movement. One common definition of constipation is less than three bowel movements per week. Other definitions include abnormally hard stools or defecation that requires excessive straining (Schiller 2001, Aliment Pharmacol Ther 15:749-763). Constipation may be idiopathic (functional constipation or slow transit constipation) or secondary to other causes including neurologic, metabolic or endocrine disorders. These disorders include diabetes mellitus, hypothyroidism, hyperthyroidism, hypocalcaemia, Multiple Sclerosis, Parkinson's disease, spinal cord lesions, Neurofibromatosis, autonomic neuropathy, Chagas disease, Hirschsprung's disease and Cystic fibrosis. Constipation may also be the result of surgery (postoperative ileus) or due to the use of drugs such as analgesics (like opioids), antihypertensives, anticonvulsants, antidepressants, antispasmodics and antipsychotics. Also disclosed are methods for increasing gastrointestinal motility in a patient, the method comprising administering to a patient a pharmaceutical composition comprising a purified peptide comprising, consisting of or consisting essentially of the amino acid sequence of SEQ ID NO:7, e.g., a peptide in FIG. 3a or FIG. 3b (SEQ ID NOs: 60-3511 and SEQ ID NOs: 1-6).

Also disclosed are methods for increasing the activity of (activating) an intestinal guanylate cyclase (GC-C) receptor in a patient, the method comprising administering to a patient a pharmaceutical composition comprising a purified peptide comprising, consisting of or consisting essentially of the amino acid sequence of SEQ ID NO:7, e.g., a peptide in FIG. 3a or FIG. 3b (SEQ ID NOs: 60-3511 and SEQ ID NOs: 1-6).

Also disclosed is an isolated nucleic acid molecule comprising a nucleotide sequence encoding a peptide comprising, consisting of or consisting essentially of SEQ ID NO:7, e.g., a peptide in FIG. 3a or FIG. 3b (SEQ ID NOs: 60-3511 and SEQ ID NOs: 1-6).

Also described is a method for treating obesity, the method comprising administering to a patient a pharmaceutical composition comprising or consisting essentially of a purified peptide comprising, consisting of or consisting essentially of the amino acid sequence of SEQ ID NO:7, e.g., a peptide in FIG. 3a or FIG. 3b (SEQ ID NOs: 60-3511 and SEQ ID NOs: 1-6).

Also described is a method for treating benign prostatic hyperplasia, the method comprising administering to a patient a pharmaceutical composition comprising a purified peptide comprising, consisting of or consisting essentially of the amino acid sequence of SEQ ID NO:7, e.g., a peptide in FIG. 3a or FIG. 3b (SEQ ID NOs: 60-3511 and SEQ ID NOs: 1-6). The peptide can be administered alone or in combination with another agent for treatment of BPH, for example, a 5-alpha reductase inhibitor (e.g., finasteride) or an alpha adrenergic inhibitor (e.g., doxazosine).

Also described is a method for treating or reducing pain, including visceral pain, pain associated with a gastrointestinal disorder or pain associated with some other disorder, the method comprising administering to a patient a pharmaceutical composition comprising or consisting essentially of a purified peptide comprising, consisting of or consisting essentially of the amino acid sequence of SEQ ID NO:7, e.g., a peptide in FIG. 3a or FIG. 3b (SEQ ID NOs: 60-3511 and SEQ ID NOs: 1-6).

Also described is a method for treating inflammation, including inflammation of the gastrointestinal tract, e.g., inflammation associated with a gastrointestinal disorder or infection or some other disorder, the method comprising administering to a patient a pharmaceutical composition comprising a purified peptide comprising, consisting of or consisting essentially of the amino acid sequence of SEQ ID NO: 7, e.g., a peptide in FIG. 3a or FIG. 3b (SEQ ID NOs: 60-3511 and SEQ ID NOs: 1-6).

In prevention and/or treatment disorders associated with fluid and sodium retention (e.g., heart failure, congestive heart failure, kidney disease, etc), the agents described herein can be administered, for example, via a parenteral route, intravenously, and/or subcutaneously. Intravenous administration may comprise, for example, (1) one or more successive rounds of a bolus followed by an infusion or an infusion followed by a bolus, (2) infusion, and (3) bolus administration. The dosage may vary depending on the administration schedule. Thus, bolus administrations may involve dosing from about 0.1-1000 ug/kg, from about 1-100 ug/kg, or from about 10, 15, 20, 25, or 30 ug/kg. Infusion administrations may involve dosing from about 0.1-1000 ug/kg/hour, from about 1-100 ug/kg/hour, about 10 ug/kg/hour. During the duration of an infusion administration, the dosage may vary (for example, decreasing over time, increasing over time, and combinations thereof) or may remain constant. Subcutaneous administration may involve dosing from about 0.1-1000 ug/kg, from about 1-100 ug/kg, from about 10, 15, 20, 25, or 30 ug/kg.

As noted above, isolated nucleic acid molecules comprising a sequence encoding a peptide described herein are described. Also described are vectors, e.g., expression vectors that include such nucleic acid molecules and can be used to express a peptide described herein in a cultured cell (e.g., a eukaryotice cell or a prokaryotic cell). The vector can further include one or more regulatory elements, e.g., a heterologous promoter or elements required for translation operably linked to the sequence encoding the peptide. In some cases the nucleic acid molecule will encode an amino acid sequence that includes the amino acid sequence of a peptide described herein. For example, the nucleic acid molecule can encode a preprotein or a preproprotein that can be processed to produce a peptide described herein. In cases where unnatural amino acids are present in the peptides described herein, selector codons can be utilized in the synthesis of such peptides similar to that described in US20060019347 (for example, paragraphs 398-408, 457-499, and 576-588)) herein incorporated by reference.

A vector that includes a nucleotide sequence encoding a peptide described herein or a peptide or peptide comprising a peptide described herein may be either RNA or DNA, single- or double-stranded, prokaryotic, eukaryotic, or viral. Vectors can include transposons, viral vectors, episomes, (e.g., plasmids), chromosomes inserts, and artificial chromosomes (e.g. BACs or YACs). Suitable bacterial hosts for expression of the encode peptide or peptide include, but are not limited to, *E. coli*. Suitable eukaryotic hosts include yeast such as *S. cerevisiae*, other fungi, vertebrate cells, invertebrate cells (e.g., insect cells), plant cells, human cells, human tissue cells, and whole eukaryotic organisms. (e.g., a transgenic plant or a transgenic animal). Further, the vector nucleic acid can be used to transfect a virus such as vaccinia or baculovirus (for example using the Bac-to-Bac® Baculovirus expression system (Invitrogen Life Technologies, Carlsbad, Calif.)).

As noted above the disclosure includes vectors and genetic constructs suitable for production of a peptide described herein or a peptide or peptide comprising such a peptide. Generally, the genetic construct also includes, in addition to the encoding nucleic acid molecule, elements that allow expression, such as a promoter and regulatory sequences. The expression vectors may contain transcriptional control sequences that control transcriptional initiation, such as promoter, enhancer, operator, and repressor sequences. A variety of transcriptional control sequences are well known to those in the art and may be functional in, but are not limited to, a bacterium, yeast, plant, or animal cell. The expression vector can also include a translation regulatory sequence (e.g., an untranslated 5' sequence, an untranslated 3' sequence, a poly A addition site, or an internal ribosome entry site), a splicing sequence or splicing regulatory sequence, and a transcription termination sequence. The vector can be capable of autonomous replication or it can integrate into host DNA.

Also described are isolated host cells harboring one of the forgoing nucleic acid molecules and methods for producing a peptide by culturing such a cell and recovering the peptide or a precursor of the peptide. Recovery of the peptide or precursor may refer to collecting the growth solution and need not involve additional steps of purification. Proteins of the present disclosure, however, can be purified using standard purification techniques, such as, but not limited to, affinity chromatography, thermaprecipitation, immunoaffinity chromatography, ammonium sulfate precipitation, ion exchange chromatography, filtration, electrophoresis and hydrophobic interaction chromatography.

The peptides can be purified. Purified peptides are peptides separated from other proteins, lipids, and nucleic acids or from the compounds from which is it synthesized. The peptide can constitute at least 10, 20, 50 70, 80 or 95% by dry weight of the purified preparation.

Also described is a method of increasing the level of cyclic guanosine 3'-monophosphate (cGMP) in an organ, tissue (e.g, the intestinal mucosa), or cell (e.g., a cell bearing GC-A receptor) by administering to a patient a composition comprising or consisting essentially of a purified peptide comprising, consisting of or consisting essentially of the amino acid sequence of SEQ ID NO:7 (e.g., a peptide in FIG. 3*a* or FIG. 3*b* (SEQ ID NOs: 60-3511 and SEQ ID NOs: 1-6)).

Also described is a method for treating hypertension. The method comprises: administering to the patient a pharmaceutical composition comprising, consisting essentially of, or consisting of a peptide or agonist described herein and a pharmaceutically acceptable carrier. The composition can be administered in combination with another agent for treatment of hypertension, for example, a diuretic, an ACE inhibitor, an angiotensin receptor blocker, a beta-blocker, or a calcium channel blocker.

Also described is a method for treating secondary hyperglycemias in connection with pancreatic diseases (chronic pancreatitis, pancreasectomy, hemochromatosis) or endocrine diseases (acromegaly, Cushing's syndrome, pheochromocytoma or hyperthyreosis), drug-induced hyperglycemias (benzothiadiazine saluretics, diazoxide or glucocorticoids), pathologic glucose tolerance, hyperglycemias, dyslipoproteinemias, adiposity, hyperlipoproteinemias and/or hypotensions is described. The method comprises: administering to the patient a pharmaceutical composition comprising, consisting essentially of, or consisting of a peptide or agonist described herein and a pharmaceutically acceptable carrier.

The peptides described herein can be present with a counterion. Useful counterions include salts of: acetate, benzenesulfonate, benzoate, calcium edetate, camsylate, carbonate, citrate, edetate (EDTA), edisylate, embonate, esylate, fumarate, gluceptate, gluconate, glutamate, glycollylarsanilate, hexylresorcinate, iodide, bromide, chloride, hydroxynaphthoate, isethionate, lactate, lactobionate, estolate, maleate, malate, mandelate, mesylate, mucate, napsylate, nitrate, pantothenate, phosphate, salicylate, stearate, succinate, sulfate, tartarate, tartrate, hydrochlorate, theoclate, acetamidobenzoate, adipate, alginate, aminosalicylate, anhydromethylenecitrate, ascorbate, aspartate, camphorate, caprate, caproate, caprylate, cinnamate, cyclamate, dichloroacetate, formate, gentisate, glucuronate, glycerophosphate, glycolate, hippurate, fluoride, malonate, napadisylate, nicotinate, oleate, orotate, oxalate, oxoglutarate, palmitate, pectinate, pectinate polymer, phenylethylbarbiturate, picrate, propionate, pidolate, sebacate, rhodanide, tosylate, and tannate.

Also described are methods for producing any of the forgoing peptides comprising providing a cell harboring a nucleic acid molecule encoding the peptide, culturing the cell under conditions in which the peptide is expressed, and isolating the expressed peptide.

Also described are methods for producing any of the forgoing peptides comprising chemically synthesizing the peptide and then purifying the synthesized peptide. Also described are pharmaceutical compositions comprising the forgoing peptides. Also described are nucleic acid molecules encoding any of the forgoing peptides, vectors (e.g., expression vectors) containing such nucleic acid molecules and host cells harboring the nucleic acid molecules or vectors.

Metabolites of Asparagine

In some cases an asparagine (Asn) of a peptide described herein can be metabolized to have a different structure and the GC receptor agonist containing such a metabolite of Asn may retain activity. Peptides where one or more Asn, e.g., one or more Asn of an embodiment of SEQ ID NO:7, e.g., a peptide in FIG. 3*a* or FIG. 3*b* (SEQ ID NOs: 60-3511 and SEQ ID NOs: 1-6) described herein are replaced by a metabolite of Asn can be useful in the methods described herein and can be present in a pharmaceutical composition that optionally contains one or more additional active ingredients.

For example, one or more Asn of a peptide and the peptide bond carboxy terminal thereto having the structure:

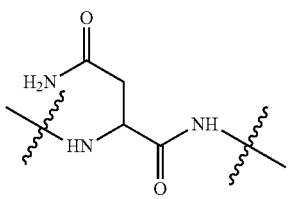 [SMILES: *NC(=O)C(CC(N)=O)N*]

can replaced by a group having a structure selected from:

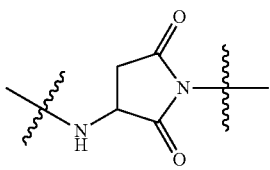 [SMILES: *NC1CC(=O)N(*)C1=O]

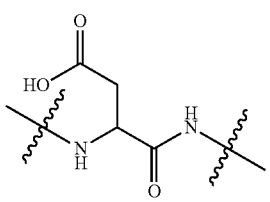

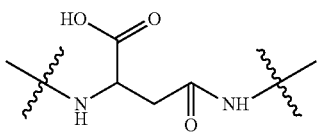

Thus, the Asn and the peptide bond carboxy terminal there to can be replaced by a cyclic imide:

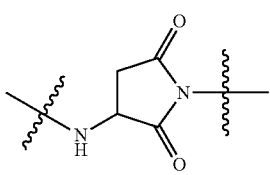

Asp:

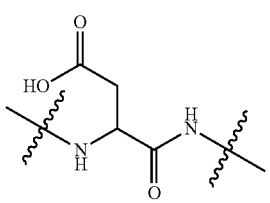

or isoAsn:

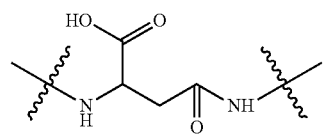

The Asp can be L-Asp or D-Asp. The isoAsn can be D-isoAsn or L-isoAsn.

Considering the asparagine only, one or more Asn having the structure:

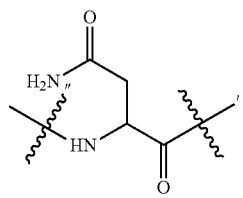

can be optionally replaced by a group having a structure selected from (a), (b) and (c):

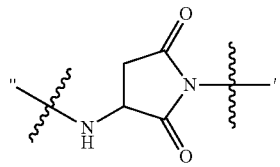
(a)

(b)

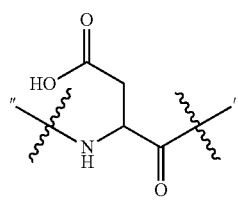
(c)

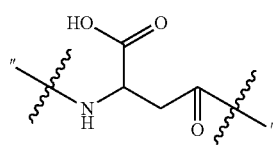

provided that an Asn at the carboxy terminus is not replaced by structure (a) or structure (c). When the Asn is at the carboxy terminus of the peptide, structure (a) cannot form. Since structure (c) is formed through structure (a), structure (c) cannot be formed when the Asn is at the carboxy terminus.

The formation of the various metabolites of Asp is depicted below.

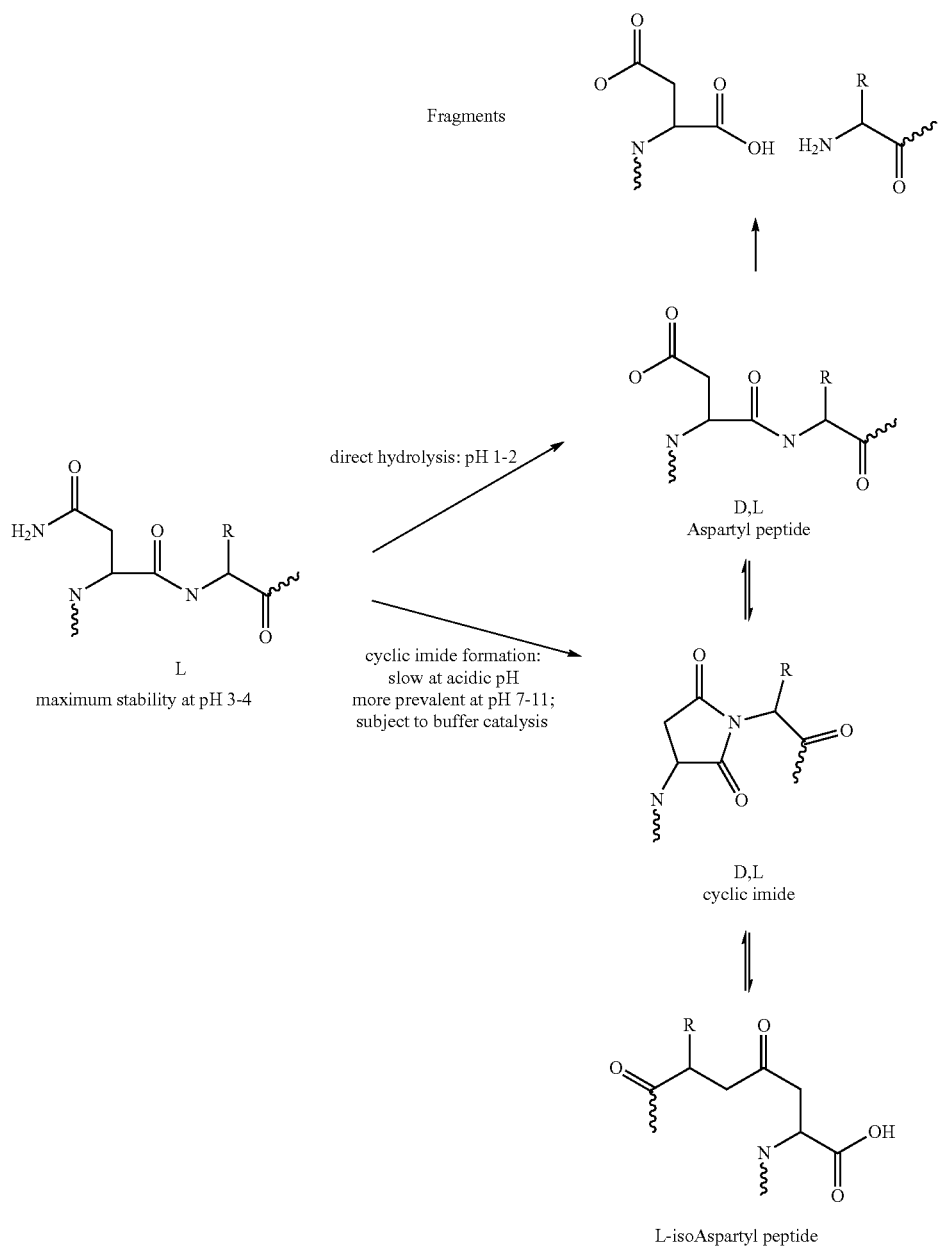

DETAILED DESCRIPTION

The peptides described herein bind to the intestinal guanylate cyclase (GC-C) receptor, a regulator of fluid and electrolyte balance. The apical membrane of the intestinal epithelial surface is a major site of GC-C receptor expression. Activation of the GC-C receptor in the intestine leads to an increase in intestinal epithelial cyclic GMP (cGMP). This increase in cGMP is believed to cause a decrease in water and sodium absorption and an increase in chloride and potassium ion secretion, leading to changes in intestinal fluid and electrolyte transport and increased intestinal motility. The intestinal GC-C receptor possesses an extracellular ligand binding region, a transmembrane region, an intracellular protein kinase-like region and a cyclase catalytic domain. Proposed functions for the GC-C receptor are fluid and electrolyte The details of one or more embodiments described herein are set forth in the accompanying description. All of the publications, patents and patent applications are hereby incorporated by reference.

FIGURES

FIG. 1 depicts the results of studies on certain peptides tested in the intestinal GC-C receptor activity assay.

FIG. 2 depicts the results of studies on certain peptides tested in the rat diuresis assay.

FIGS. 3a and 3b depict certain peptides within SEQ ID NO:7.

FIG. 4 depicts various pre, pro, N-terminal non-core, and C-terminal non-core sequences that can be included in a peptide comprising SEQ ID NO:7.

homeostasis, the regulation of epithelial cell proliferation and the induction of apoptosis (Shalubhai 2002 Curr Opin Drug Dis Devel 5:261-268).

In addition to being expressed in the intestine by gastrointestinal epithelial cells, GC-C is expressed in extra-intestinal tissues including kidney, lung, pancreas, pituitary, adrenal, developing liver and gall bladder (reviewed in Vaandrager 2002 Mol Cell Biochem 230:73-83, Kulaksiz et al. 2004, Gastroenterology 126:732-740) and male and female reproductive tissues (reviewed in Vaandrager 2002 Mol Cell Biochem 230:73-83). This suggests that the GC-C receptor agonists can be used in the treatment of disorders outside the GI tract, for example, congestive heart failure and benign prostatic hyperplasia.

In humans, the GC-C receptor is activated by guanylin (Gn) (U.S. Pat. No. 5,969,097), uroguanylin (Ugn) (U.S. Pat. No. 5,140,102) and lymphoguanylin (Forte et al. 1999 Endocrinology 140:1800-1806). Interestingly, these agents are 10-100 fold less potent than a class of bacterially derived peptides, termed ST (reviewed in Gianella 1995 J Lab Clin Med 125:173-181). ST peptides are considered super agonists of GC-C and are very resistant to proteolytic degradation.

ST peptide is capable of stimulating the enteric nervous system (Rolfe et al., 1994, J Physiolo 475: 531-537; Rolfe et al. 1999 Gut 44: 615-619; Nzegwu et al. 1996 Exp Physiol 81: 313-315). Also, cGMP has been reported to have antinociceptive effects in multiple animal models of pain (Lazaro Ibanez et al. 2001 Eur J Pharmacol 426: 39-44; Soares et al. 2001 British J Pharmacol 134: 127-131; Jain et al. 2001 Brain Res 909:170-178; Amarante et al. 2002 Eur J Pharmacol 454:19-23). Thus, GC-C agonists may have both an analgesic as well an anti-inflammatory effect.

In bacteria, ST peptides are derived from a preproprotein that generally has at least 70 amino acids. The pre and pro regions are cleaved as part of the secretion process, and the resulting mature protein, which generally includes fewer than 20 amino acids, is biologically active.

Among the known bacterial ST peptides are: *E. coli* ST Ib (Moseley et al. 1983 Infect. Immun. 39:1167) having the mature amino acid sequence Asn Ser Ser Asn Tyr Cys Cys Glu Leu Cys Cys Asn Pro Ala Cys Thr Gly Cys Tyr (SEQ ID NO:8); *E. coli* ST Ia (So and McCarthy 1980 Proc. Natl. Acad. Sci. USA 77:4011) having the mature amino acid sequence Asn Thr Phe Tyr Cys Cys Glu Leu Cys Cys Asn Pro Ala Cys Ala Gly Cys Tyr (SEQ ID NO:9). *E. coli* ST I* (Chan and Giannella 1981 J. Biol. Chem. 256:7744) having the mature amino acid sequence Asn Thr Phe Tyr Cys Cys Glu Leu Cys Cys Tyr Pro Ala Cys Ala Gly Cys Asn (SEQ ID NO:10); *C. freundii* ST peptide (Guarino et al. 1989b Infect. Immun. 57:649) having the mature amino acid sequence Asn Thr Phe Tyr Cys Cys Glu Leu Cys Cys Asn Pro Ala Cys Ala Gly Cys Tyr (SEQ ID NO:11); *Y. enterocolitica* ST peptides, Y-ST(Y-STa), Y-STb, and Y-STc (reviewed in Huang et al. 1997 Microb. Pathog. 22:89) having the following pro-form amino acid sequences: Gln Ala Cys Asp Pro Pro Ser Pro Pro Ala Glu Val Ser Ser Asp Trp Asp Cys Cys Asp Val Cys Cys Asn Pro Ala Cys Ala Gly Cys (SEQ ID NO:12) (as well as a Ser-7 to Leu-7 variant of Y-STa (SEQ ID NO:13), (Takao et al. 1985 Eur. J. Biochem. 152:199)); Lys Ala Cys Asp Thr Gln Thr Pro Ser Pro Ser Glu Glu Asn Asp Asp Trp Cys Cys Glu Val Cys Cys Asn Pro Ala Cys Ala Gly Cys (SEQ ID NO:14); Gln Glu Thr Ala Ser Gly Gln Val Gly Asp Val Ser Ser Ser Thr Ile Ala Thr Glu Val Ser Glu Ala Ala Glu Cys Gly Thr Glu Ser Ala Thr Thr Gln Gly Glu Asn Asp Trp Asp Trp Cys Cys Glu Leu Cys Cys Asn Pro Ala Cys Phe Gly Cys (SEQ ID NO:15), respectively; *Y. kristensenii* ST peptide having the mature amino acid sequence Ser Asp Trp Cys Cys Glu Val Cys Cys Asn Pro Ala Cys Ala Gly Cys (SEQ ID NO:16); *V. cholerae* non-01 ST peptide (Takao et al. (1985) FEBS lett. 193:250) having the mature amino acid sequence Ile Asp Cys Cys Glu Ile Cys Cys Asn Pro Ala Cys Phe Gly Cys Leu Asn (SEQ ID NO:17); and *V. mimicus* ST peptide (Arita et al. 1991 FEMS Microbiol. Lett. 79:105) having the mature amino acid sequence Ile Asp Cys Cys Glu Ile Cys Cys Asn Pro Ala Cys Phe Gly Cys Leu Asn (SEQ ID NO:18).

The immature (including pre and pro regions) form of *E. coli* ST-1A (ST-P) protein has the sequence: mkklmlaifisvlsfpsfsqstesldsskekitletkkcdv-vknnsekksenmnntfyccelccnpacagcy (SEQ ID NO:19; see GenBank® Accession No. P01559 (gi:123711). The pre sequence extends from aa 1-19. The pro sequence extends from aa 20-54. The mature protein extends from 55-72. The immature (including pre and pro regions) form of *E. coli* ST-1B (ST-H) protein has the sequence: mkksilfiflsvlsfspfaqdakpvesskekitleskkc-niakksnksgpesmnssnyccelccnpactgcy (SEQ ID NO:20; see GenBank® Accession No. P07965 (gi:3915589)). The immature (including pre and pro regions) form of *Y. enterocolitica* ST protein has the sequence: mkkivfvlvmlssfgafgqetvsgqfsdalstpitaevykqacdpplppaevssdwdccdvccnpacagc (SEQ ID NO:21; see GenBank® Accession No. 525659 (gi:282047)). The peptides described herein, e.g., a peptide comprising SEQ ID NO:7 (e.g., a peptide of FIG. 3*a* or FIG. 3*b* (SEQ ID NOs: 60-3511 and SEQ ID NOs: 1-6)) can include all or part of such pre and/or pro sequences.

FIG. 4 depicts various pre, pro, N-terminal non-core, and C-terminal non-core sequences that can be included in a peptide comprising SEQ ID NO:7 (e.g., a peptide of FIG. 3*a* or FIG. 3*b* (SEQ ID NOs: 60-3511 and SEQ ID NOs: 1-6)). Thus, a peptide can include the amino acid sequence:

A'-B'-C'-D'-E' wherein:
A' is an amino acid sequence comprising a pre sequence depicted in FIG. 4 or is missing;
B' is an amino acid sequence comprising a pro sequence depicted in FIG. 4 or is missing;
C' is an amino acid sequence comprising an N-terminal non-core sequence depicted in FIG. 4 or is missing;
D' is an amino acid sequence comprising a GC-C receptor agonist peptide amino acid sequence (e.g., SEQ ID NO:7, a peptide in FIG. 3*a* or a peptide in FIG. 3*b* (SEQ ID NOs: 60-3511 and SEQ ID NOs: 1-6)); and
E' is an amino acid sequence comprising a C-terminal non-core sequence depicted in FIG. 4 or is missing;

The peptides described herein, like the bacterial ST peptides, have six Cys (or D-Cys) residues. These six residues form three disulfide bonds in the mature and active form of the peptide. If the six Cys (or D-Cys) residues are identified, from the amino to carboxy terminus of the peptide, as A, B, C, D, E, and F, then the disulfide bonds form as follows: A-D, B-E, and C—F. The formation of these bonds is thought to be important for GC-C receptor binding.

Certain of the peptides described herein may include analgesic or antinociceptive tags such as the carboxy-terminal sequence AspPhe immediately following a Trp, Tyr or Phe that creates a functional chymotrypsin cleavage site or following Lys or Arg that creates a functional trypsin cleavage site. Chymotrypsin in the intestinal tract can potentially cleave such peptides immediately carboxy terminal to the Trp, Phe or Tyr residue, releasing the dipeptide, AspPhe. This dipeptide has been shown to have analgesic activity in animal models (Abdikkahi et al. 2001 Fundam Clin Pharmacol 15:117-23; Nikfar et al 1997, 29:583-6; Edmundson et al 1998 Clin Pharmacol Ther 63:580-93). In this manner such peptides can treat both pain and inflammation. Other analgesic peptides can be present at the amino or carboxy terminus of the peptide (e.g., following a functional cleavage site) including: endomorphin-1, endomorphin-2, nocistatin, dalargin, lupron, and substance P.

In some cases, the peptides described herein are produced as a prepro protein that includes the amino terminal leader sequence: mkksilfiflsvlsfspfaqdakpvesskekitleskkcniakksnksgpesmn (SEQ ID NO:41). Where the peptide is produced by a bacterial cell, e.g., E. coli, the forgoing leader sequence will be cleaved and the mature peptide will be efficiently secreted from the bacterial cell. U.S. Pat. No. 5,395,490 describes vectors, expression systems and methods for the efficient production of ST peptides in bacterial cells and methods for achieving efficient secretion of mature ST peptides. The vectors, expression systems and methods described in U.S. Pat. No. 5,395,490 can be used to produce the ST peptides and variant ST peptides of the present disclosure Variant Peptides The disclosure includes variant peptides which can include one, two, three, four, five, six, seven, eight, nine, or ten (in some embodiments fewer than 5 or fewer than 3 or 2 or fewer) amino acid substitutions and/or deletions compared to the sequences of SEQ ID NO:7 (e.g., a sequence in FIG. 3a or FIG. 3b (SEQ ID NOs: 60-3511 and SEQ ID NOs: 1-6)) The substitution(s) can be conservative or non-conservative. The naturally-occurring amino acids can be substituted by D-isomers of any amino acid, non-natural amino acids, natural and natural amino acid analogs and other groups. A conservative amino acid substitution results in the alteration of an amino acid for a similar acting amino acid, or amino acid of like charge, polarity, or hydrophobicity. At some positions, even conservative amino acid substitutions can alter the activity of the peptide. A conservative substitution can substitute a naturally-occurring amino acid for a non-naturally-occurring amino acid. The amino acid substitutions among naturally-occurring amino acids are listed in Table II.

TABLE II

| For Amino Acid | Code | Replace with any of |
| --- | --- | --- |
| Alanine | Ala | Gly, Cys, Ser |
| Arginine | Arg | Lys, His |
| Asparagine | Asn | Asp, Glu, Gln |
| Aspartic Acid | Asp | Asn, Glu, Gln |
| Cysteine | Cys | Met, Thr, Ser |
| Glutamine | Gln | Asn, Glu, Asp |
| Glutamic Acid | Glu | Asp, Asn, Gln |
| Glycine | Gly | Ala |
| Histidine | His | Lys, Arg |
| Isoleucine | Ile | Val, Leu, Met |
| Leucine | Leu | Val, Ile, Met |
| Lysine | Lys | Arg, His |
| Methionine | Met | Ile, Leu, Val |
| Phenylalanine | Phe | Tyr, His, Trp |
| Proline | Pro | |
| Serine | Ser | Thr, Cys, Ala |
| Threonine | Thr | Ser, Met, Val |
| Tryptophan | Trp | Phe, Tyr |
| Tyrosine | Tyr | Phe, His |
| Valine | Val | Leu, Ile, Met |

In some circumstances it can be desirable to treat patients with a variant peptide that binds to and activates intestinal GC-C receptor, but is less active than the non-variant form the peptide. This reduced activity can arise from reduced affinity for the receptor or a reduced ability to activate the receptor once bound or reduced stability of the peptide.

Production of Peptides

Useful peptides can be produced either in bacteria including, without limitation, E. coli, or in other existing systems for peptide or protein production (e.g., Bacillus subtilis, baculovirus expression systems using Drosophila Sf9 cells, yeast or filamentous fungal expression systems, mammalian cell expression systems), or they can be chemically synthesized.

If the peptide or variant peptide is to be produced in bacteria, e.g., E. coli, the nucleic acid molecule encoding the peptide will preferably also encode a leader sequence that permits the secretion of the mature peptide from the cell. Thus, the sequence encoding the peptide can include the pre sequence and the pro sequence of, for example, a naturally-occurring bacterial ST peptide. The secreted, mature peptide can be purified from the culture medium.

The sequence encoding a peptide described herein is preferably inserted into a vector capable of delivering and maintaining the nucleic acid molecule in a bacterial cell. The DNA molecule may be inserted into an autonomously replicating vector (suitable vectors include, for example, pGEM3Z and pcDNA3, and derivatives thereof). The vector nucleic acid may be a bacterial or bacteriophage DNA such as bacteriophage lambda or M13 and derivatives thereof. Construction of a vector containing a nucleic acid described herein can be followed by transformation of a host cell such as a bacterium. Suitable bacterial hosts include but are not limited to, E. coli, B. subtilis, Pseudomonas, Salmonella. The genetic construct also includes, in addition to the encoding nucleic acid molecule, elements that allow expression, such as a promoter and regulatory sequences. The expression vectors may contain transcriptional control sequences that control transcriptional initiation, such as promoter, enhancer, operator, and repressor sequences. A variety of transcriptional control sequences are well known to those in the art. The expression vector can also include a translation regulatory sequence (e.g., an untranslated 5' sequence, an untranslated 3' sequence, or an internal ribosome entry site). The vector can be capable of autonomous replication or it can integrate into host DNA to ensure stability during peptide production.

The protein coding sequence that includes a peptide described herein can also be fused to a nucleic acid encoding a peptide affinity tag, e.g., glutathione S-transferase (GST), maltose E binding protein, protein A, FLAG tag, hexa-histidine, myc tag or the influenza HA tag, in order to facilitate purification. The affinity tag or reporter fusion joins the reading frame of the peptide of interest to the reading frame of the gene encoding the affinity tag such that a translational fusion is generated. Expression of the fusion gene results in translation of a single peptide that includes both the peptide of interest and the affinity tag. In some instances where affinity tags are utilized, DNA sequence encoding a protease recognition site will be fused between the reading frames for the affinity tag and the peptide of interest.

Genetic constructs and methods suitable for production of immature and mature forms of the peptides and variants described herein in protein expression systems other than bacteria, and well known to those skilled in the art, can also be used to produce peptides in a biological system.

Mature peptides and variants thereof can be synthesized by the solid-phase chemical synthesis. For example, the peptide can be synthesized on Cyc(4-CH$_2$Bxl)-OCH$_2$-4-(oxymethyl)-phenylacetamidomethyl resin using a double coupling program. Protecting groups must be used appropriately to create the correct disulfide bond pattern. For example, the following protecting groups can be used: t-butyloxycarbonyl (alpha-amino groups); acetamidomethyl (thiol groups of Cys residues B and E); 4-methylbenzyl (thiol groups of Cys residues C and F); benzyl (γ-carboxyl of glutamic acid and the hydroxyl group of threonine, if present); and bromobenzyl (phenolic group of tyrosine, if present). Coupling is effected with symmetrical anhydride of t-butoxylcarbonylamino acids or hydroxybenzotriazole ester (for asparagine or glutamine residues), and the peptide is deprotected and cleaved from the solid support in hydrogen fluoride, dimethyl sulfide, anisole, and p-thiocresol using 8/1/1/0.5 ratio (v/v/v/w) at 0° C. for 60 min. After removal of hydrogen fluoride and dimethyl sulfide by reduced pressure and anisole and p-thiocresol by extraction with ethyl ether and ethyl acetate sequentially, crude peptides are extracted with a mixture of 0.5M sodium phosphate buffer, pH 8.0 and N,N-dimethylformamide using 1/1 ratio, v/v. The disulfide bond for Cys residues B and E is the formed using dimethyl sulfoxide (Tam et al. (1991) *J. Am. Chem. Soc.* 113:6657-62). The resulting peptide is the purified by reverse-phase chromatography. The disulfide bond between Cys residues C and F is formed by first dissolving the peptide in 50% acetic acid in water. Saturated iodine solution in glacial acetic acid is added (1 ml iodine solution per 100 ml solution). After incubation at room temperature for 2 days in an enclosed glass container, the solution is diluted five-fold with deionized water and extracted with ethyl ether four times for removal of unreacted iodine. After removal of the residual amount of ethyl ether by rotary evaporation the solution of crude product is lyophilized and purified by successive reverse-phase chromatography.

Peptides can also be synthesized by many other methods including solid phase synthesis using traditional FMOC protection (i.e., coupling with DCC-HOBt and deprotection with piperidine in DMF). Cys thiol groups can be trityl protected. Treatment with TFA can be used for final deprotection of the peptide and release of the peptide from the solid-state resin. In many cases air oxidation is sufficient to achieve proper disulfide bond formation.

Example 1

Preparation of Peptides

Peptides can be recombinantly produced in bacteria as follows. T7 expression vectors, pET26b(+) (Novagen) expressing the peptide of interest are constructed using standard molecular biology techniques and are transformed into *E. coli* bacterial host BL21λ DE3 (Invitrogen). A single colony is innoculated and grown shaking overnight at 30° C. in L broth+25 mg/l kanamycin. The overnight culture is added to 3.2 L of batch medium (Glucose 25 g/l, Casamino Acids 5 g/l, Yeast Extract 5 g/l, $KH_2PO_4$ 13.3 g/l, $(NH_4)_2HPO_4$ 4 g/l, $MgSO_4 \cdot 7H_2O$ 1.2 µl, Citric Acid 1.7 g/l, EDTA 8.4 mg/l, $CoCl_2\text{-}6H_2O$ 2.5 mg/l, $MnCl_2\text{-}4H_2O$ 15 mg/l, $CuCl_2\text{-}4H_2O$ 1.5 mg/l, $H_3BO_3$ 3 mg/l, $Na_2MoO_4\text{-}2H_2O$ 2.5 mg/l, Zn Acetate-$2H_2O$ 13 mg/l, Ferric Citrate 100 mg/l, Kanamycin 25 mg/l, Antifoam $DF_2O_4$ 1 ml/l) and fermented using the following process parameters: pH 6.7-control with base only (28% $NH_4OH$), 30° C., aeration: 5 liters per minute. After the initial consumption of batch glucose (based on monitoring dissolved oxygen (DO) levels), 1.5 L of feed medium (Glucose 700 g/l, Casamino Acids 10 g/l, Yeast Extract 10 g/l, $MgSO_4\text{-}7H_2O$ 4 g/l, EDTA 13 mg/l, $CoCl_2\text{-}6H_2O$ 4 mg/l, $MnCl_2\text{-}4H_2O$ 23.5 mg/l, $CuCl_2\text{-}4H_2O$ 2.5 mg/l, $H_3BO_3$ 5 mg/l, $Na_2MoO_4\text{-}2H_2O$ 4 mg/l, Zn Acetate-$2H_2O$ 16 mg/l, Ferric Citrate 40 mg/l, Antifoam $DF_2O_4$ 1 ml/l) is added at a feed rate controlled to maintain 20% DO. IPTG is added to 0.2 mM 2 hours post feed start. The total run time is approximately 40-45 hours (until feed exhaustion).

Cells are collected by centrifugation at 5,000 g for 10 minutes. The cell pellet is discarded and the supernatant is passed through a 50 Kd ultrafiltration unit. The 50 Kd filtrate (0.6 liters) is loaded onto a 110 ml Q-Sepharose fast Flow column (Amersham Pharmacia, equilibrated with 20 mM Tris-HCl pH 7.5) at a flow rate of 400 ml/hour. The column is washed with six volumes of 20 mM Tris-HCl pH 7.5 and proteins are eluted with 50 mM acetic acid collecting 50 ml fractions. Fractions containing peptide are pooled and the solvent is removed by rotary evaporation. The dried proteins are resuspended in 10 ml of 8% acetic acid, 0.1% trifluoroacetic acid (TFA) and loaded onto a Varian Polaris C18-A column (250×21.2 mm 10™, equilibrated in the same buffer) at a flow rate of 20 ml/min. The column is washed with 100 ml of 8% methanol, 0.1% TFA and developed with a gradient (300 ml) of 24 to 48% methanol, 0.1% TFA, collecting 5-ml fractions. Fractions containing peptide are pooled and the solvent is removed by rotary evaporation. The peptides are dissolved in 0.1% TFA and lyophilized.

Peptide fractions are analyzed by standard LCMS and HPLC. Peptides can also be chemically synthesized by a commercial peptide synthesis company.

Example 2

Activation of the Intestinal GC-C Receptor by Peptides

The ability of peptides to activate the intestinal GC-C receptor was assessed in an assay employing the T84 human colon carcinoma cell line (American Type Culture Collection (Bethesda, Md.)). For the assays cells were grown to confluency in 24-well culture plates with a 1:1 mixture of Ham's F12 medium and Dulbecco's modified Eagle's medium (DMEM), supplemented with 5% fetal calf serum and were used at between passages 54 and 60.

Briefly, monolayers of T84 cells in 24-well plates were washed twice with 1 ml/well DMEM, then incubated at 37° C. for 10 min with 0.45 ml DMEM containing 1 mM isobutyl-methylxanthine (IBMX), a cyclic nucleotide phosphodiesterase inhibitor. Test peptides (500) were then added and incubated for 30 minutes at 37° C. The media was aspirated and the reaction was then terminated by the addition of ice cold 0.5 ml of 0.1N HCl. The samples were held on ice for 20 minutes and then evaporated to dryness using a heat gun or vacuum centrifugation. The dried samples were resuspended in 0.5 ml of phosphate buffer provided in the Cayman Chemical Cyclic GMP EIA kit (Cayman Chemical, Ann Arbor, Mich.). Cyclic GMP was measured by EIA according to procedures outlined in the Cayman Chemical Cyclic GMP EIA kit. FIG. 1 shows the activity of chemically synthesized peptide variants (depicted below) in the GC-C receptor activity assay. $EC_{50}$ is defined as the concentration by which 50% of the maximal activity is seen. Maximum cGMP level in assay is determined as the activity of the positive ST control, Cys-Cys-Glu-Leu-Cys-Cys-Asn-Pro-Ala-Cys-Thr-Gly-Cys-Tyr SEQ ID NO:6 and set to 100%. The positive control was tested twice in this assay.

Example 3

Diuresis and Naturesis Assays

Effect on Diuresis and Natriuresis

The effect of peptides/GC-agonists described herein on diuresis and natriuresis can be determined using methodology similar to that described in WO06/001931 (examples 6

(p. 42) and 8 (p. 45)). Briefly, a peptide described herein (180-pmol) is infused for 60 min into a group of 5 anesthetized rats. Given an estimated rat plasma volume of 10 mL, the infusion rate is approximately 3 μmol/mL/min. Blood pressure, urine production, and sodium excretion are monitored for approximately 40 minutes prior to the infusion, during the infusion, and for approximately 50 minutes after the infusion to measure the effect of the peptide/GC-C agonist on diuresis and natriuresis. For comparison, a control group of five rats is infused with regular saline. Urine and sodium excretion can be assessed. Dose response can also be determined. A peptide/GC-C agonist described herein is infused intravenously into rats over 60 minutes. Urine is collected at 30 minute intervals up to 180 minutes after termination of peptide/GC-C agonist infusion, and urine volume, sodium excretion, and potassium excretion are determined for each collection interval. Blood pressure is monitored continuously. For each dose a dose-response relationship for urine volume, sodium and potassium excretion can be determined. Plasma concentration of the peptide/GC-agonist is also determined before and after iv infusion.

Rat Diuresis Experiment

Female Sprague-Dawley rats (>170 g, 2-8 per group) are given 3.0 mL of iosotonic saline perorally, and then anesthetized with isoflurane/oxygen. Once an appropriate level of anesthesia has been achieved, a sterile polyurethane catheter (~16 cm, 0.6 mm ID, 0.9 mm OD) is inserted 1.5-2.0 cm into the urethra and secured using 1-2 drops of veterinary bond adhesive applied to urethra/catheter junction. Rats are then dosed with either vehicle or test article via the intravenous or intraperitoneal route. Rats are then placed in appropriately sized rat restraint tubes, with the catheter protruding out of the restraint tube into a 10 mL graduated cylinder. Rats are allowed to regain consciousness, and the volume of urine excreted over a 1-5 hour duration is recorded periodically for each rat. FIG. 2 shows the results of several peptides described herein tested in the rat diuresis assay.

Example 4

Kd Determination and Binding Assays

A competition binding assay can be performed using rat intestinal epithelial cells to determine the affinity of a peptide for intestinal GC-G receptor. Epithelial cells from the small intestine of rats are obtained as described by Kessler et al. (*J. Biol. Chem.* 245: 5281-5288 (1970)). Briefly, animals are sacrificed and their abdominal cavities exposed. The small intestine is rinsed with 300 ml ice cold saline or PBS. 10 cm of the small intestine measured at 10 cm from the pylorus is removed and cut into 1 inch segments. Intestinal mucosa is extruded from the intestine by gentle pressure between a piece of parafilm and a P-1000 pipette tip. Intestinal epithelial cells are placed in 2 ml PBS and pipetted up and down with a 5 ml pipette to make a suspension of cells. Protein concentration in the suspension is measured using the Bradford method (*Anal. Biochem.* 72: 248-254 (1976)).

A competition binding assay can be performed based on the method of Giannella et al. (*Am. J. Physiol.* 245: G492-G498) between [$^{125}$I] labeled peptide. The assay mixture contains: 0.5 ml of DME with 20 mM HEPES-KOH pH 7.0, 0.9 mg of the cell suspension listed above, 21.4 fmol [$^{125}$I]-SEQ ID NO:4 (42.8 pM), and different concentrations of competitor peptide (0.01 to 1000 nM). The mixture is incubated at room temperature for 1 hour, and the reaction is stopped by applying the mixture to GF/B glass-fiber filters (Whatman). The filters are washed with 5 ml ice-cold PBS and radioactivity is measured. Giannella et al. (*Am. J. Physiol.* 245: G492-G498) observed that the Kd for wild-type ST peptide in this same assay is ~13 nm.

Similar competition binding assays can be performed in intestinal epithelial cells from wild-type and guanylate cyclase C knockout (GC-C KO; Mann et al. 1997 Biochem and Biophysical Research Communications 239:463) mice. Mouse intestinal epithelial cells are prepared as described above for rat intestinal epithelial cells except the cells are homogenized with an Omni homogenizer for 20 seconds on the maximum setting to make a suspension of cells.

The binding of peptides to GC-C receptors on the cell surface of human colonic cells (T84 cells; ATCC Catalog No. CCL-248) can be characterized in a competitive radioligand-binding assay at pH conditions of 5, 7 and 8. The radiolabeled tracer used in these experiments is $^{125}$I-labeled control peptide. To determine binding constants, competitive inhibition of binding is used. T84 cells are cultured in T-150 plastic flasks in DMEM and Ham's F-12 medium containing 5% fetal bovine serum. Monolayers at 60-70% confluency (approximately $10^7$ cells) are collected by gentle scraping followed by centrifugation, and washed twice in 50 mL of phosphate-buffered saline (PBS). The cells are resuspended in 1 mL DMEM containing 20 mM N-(2-hydroxymethyl)piperazine-N'-(2-ethanesulfonic acid) (Hepes), pH 7.0 and 0.5% bovine serum albumin (BSA). T84 cells are incubated with a constant amount of $^{125}$I-control peptide containing various concentrations of cold competitor. Free $^{125}$I-control peptide is separated from bound tracer by rapid suction filtration. The binding reactions are carried out in 1.5 mL microfuge tubes in 0.24 mL of DMEM/20 mM Hepes pH 7.0/0.5% BSA containing: $2.5 \times 10^5$ T84 cells (0.25 mg protein), 200,000 cpm $^{125}$I-control peptide (41 fmol, 170 μM), and 0.01 to 1,000 nM competitor. Binding assays at pH 5.0 are done in DMEM/20 mM 2-(N-morpholino) ethanesulfonic acid (Mes), pH 5.0. Binding assays in pH 8.0 are done in DMEM/20 mM Hepes/ 50 mM sodium bicarbonate pH 8.0. One sample contains no competitor ($B_0$) and another contained no cells. After incubation at 37° C. for 1 h, the reaction mixtures are applied to Whatman GF/B glass-fiber filters by suction filtration. The filters are then rinsed with 10 mL ice-cold PBS buffer, inserted into plastic tubes, and added to 2 mL scintillation fluid. Radioactivity is measured in a LS 6500 liquid scintillation counter (Beckman-Coulter). The percent bound in each sample is calculated by the equation:

$$\% B/B_0 = (\text{sample cpm} - \text{no cells cpm}) \times 100 / (B_0 \text{ cpm} - \text{no cells cpm})$$

Nonlinear regression analysis of the binding data is used to calculate the concentration of competitor that resulted in 50% radioligand bound ($IC_{50}$). The apparent dissociation equilibrium constant ($K_i$) for each competitor is obtained from the $IC_{50}$ values and the previously reported estimate of the dissociation constant for the radioligand, $K_d \cong 15$ nM (Hamra et al. 1997 PNAS 2705-10) and the method of Cheng and Prusoff 1973 Biochem Pharmacol 22:3099-108. Using a two site model, high and low affinity-binding sites are identified on T84 cells ($K_{i1}$ and $K_{i2}$) for all the test agents.

Example 5

Pharmacokinetic Properties of Peptides

To study the pharmacokinetics of peptides, absorbability studies in mice are performed by administering a peptide intravaneously via tail vein injection or orally by gavage to 8-week-old CD1 mice. Serum is collected from the animals at various time points and tested for the presence of peptide using a competitive enzyme-linked immunoabsorbent assay.

A similar bioavailability study can be performed in which LCMS rather than ELISA is used to detect peptide. Initially, serum samples are extracted from the whole blood of exposed and control mice, then injected directly (10 mL) onto an in-line solid phase extraction (SPE) column (Waters Oasis HLB 25 μm column, 2.0×15 mm direct connect) without further processing. The sample on the SPE column is washed with a 5% methanol, 95% dH$_2$O solution (2.1 mL/min, 1.0 minute), then loaded onto an analytical column using a valve switch that places the SPE column in an inverted flow path onto the analytical column (Waters Xterra MS C8 5 μm IS column, 2.1×20 mm). The sample is eluted from the analytical column with a reverse phase gradient (Mobile Phase A: 10 mM ammonium hydroxide in dH$_2$O, Mobile Phase B: 10 mM ammonium hydroxide in 80% acetonitrile and 20% methanol; 20% B for the first 3 minutes then ramping to 95% B over 4 min. and holding for 2 min., all at a flow rate of 0.4 mL/min.). At 9.1 minutes, the gradient returns to the initial conditions of 20% B for 1 min. Peptide is eluted from the analytical column, and it is detected by triple-quadrapole mass spectrometry. Instrument response is converted into concentration units by comparison with a standard curve using known amounts of chemically synthesized peptide prepared and injected in mouse serum using the same procedure.

Similarly, oral bioavailabity is determined in rats using LCMS methodology. Rat plasma samples containing peptide are extracted using a Waters Oasis MAX 96 well solid phase extraction (SPE) plate. A 200 μL volume of rat plasma is mixed with 200 μL of $^{13}$C, $^{15}$N—peptide in the well of a prepared SPE plate. The samples are drawn through the stationary phase with 15 mm Hg vacuum. All samples are rinsed with 200 μL of 2% ammonium hydroxide in water followed by 200 μL of 20% methanol in water. The samples are eluted with consecutive 100 μL volumes of May 20, 1975 formic acid/water/methanol and 100 μL May 15, 1980 formic acid/water/methanol. The samples are dried under nitrogen and resuspended in 100 μL of 20% methanol in water. Samples are analyzed by a Waters Quattro Micro mass spectrometer coupled to a Waters 1525 binary pump with a Waters 2777 autosampler. A 40 μL volume of each sample is injected onto a Thermo Hypersil GOLD C18 column (2.1×50 mm, 5 Tm). Peptides are eluted by a gradient over 3 minutes with acetonitrile and water containing 0.05% trifluoroacetic acid.

Oral bioavailability can also be determined using a radioimmunoassay (RIA) detection method. Female CD-1 mice (Charles River, Wilmington, Mass.) weighing approximately 25 g (7-8 weeks old) or female CD rats (Charles River, Wilmington, Mass.) weighing approximately 153 g are included in this study. Monoclonal antibody recognizing the peptide and $^{125}$I labeled-peptide, a labeled tracer, are used in these experiments. Animals are fasted overnight before administration of compounds. Blood is drawn from all dosed animals by retroorbital eye bleeding at specific intervals and test compound levels are analyzed by radioimmunoassay (RIA). Samples (80 μL) are first diluted to 0.5 mL with start buffer (8% methanol, 0.095% TFA in water) and applied to C18 columns previously conditioned with 1 mL methanol and equilibrated with 2 mL of start buffer. After washing with 1 mL start buffer, peptide is eluted with 0.8 mL of 80% methanol, 0.05% TFA and dried down in a centrifugal evaporator. Samples are reconstituted in 0.194 mL assay buffer (PBS buffer, pH 7.4, containing 10% fetal bovine serum). Standard dilutions of peptide are made in rat plasma. To perform RIA analysis, samples from dosed animal and standards are mixed with 5 μL diluted antibody (in RIA wash buffer: phosphate-buffered saline (PBS) containing 0.1% bovine serum albumin (BSA), 1:40,000 final dilution, 0.0022 μg), and incubated 1 to 4 h at 4° C. One tube contains the zero standard ($B_0$) and another no standard and no antibody (non-specific binding, NSB). Labeled tracer (0.018 μCi, diluted in RIA wash buffer) is then added and incubated at 4° C. for 12 to 18 h. The antibody bound fraction containing peptide is collected by magnetic separation using 10 μL of sheep anti-mouse IgG beads previously washed twice in 10 volumes RIA assay buffer. The beads are then washed twice with 1 mL of RIA wash buffer, collected by magnetic separation, resuspended in 0.1 mL of RIA wash buffer, and added to 2 mL scintillation fluid. Radioactivity is measured in a LS 6500 scintillation counter (Beckman-Coulter). The binding efficiency is defined as the percent radioactivity in the $B_0$ sample compared to the input counts. The percent bound in each sample is calculated by the equation:

$$\% B/B_0 = (\text{sample cpm} - \text{NSB cpm}) \times 100/(B_0 \text{ cpm} - \text{NSB cpm})$$

A standard curve is prepared by plotting % $B/B_0$ as a function of the 10 g peptide concentration. A concentration vs. time plot is generated from the data in GraphPad Prism or Summit Software PK Solutions 2.0 to generate oral and i.v. PK curves. The area under the curve from T=0 to 4 hours ($AUC_{0-4h}$) is calculated by the software for both p.o. and i.v. dosed animals. If the values are below the lower limit of detection (LOD) than the LOD is used to estimate the value (in this experiment 2 nM). Oral Bioavailabilty (F) is calculated using the equation:

$$F = (AUC_{p.o.,(0-4h)} * D_{i.v.})/(AUC_{i.v.,(0-4h)} * D_{p.o.})$$

where $D_{i.v.}$ and $D_{p.o.}$ equal the intravenous and oral dose, respectively.

Example 6

In Vitro Proteolytic Stability of Peptides

The stability of peptides in the presence of several mammalian digestive enzymes can be determined. Peptides are exposed to a variety of in vitro conditions including digestive enzymes and low ph environments designed to simulate gastric fluid. Peptides are incubated with chymotrypsin, trypsin, pepsin, aminopeptidase, carboxypeptidase A, or simulated gastric fluid (sgf) at ph 1.0. Samples are collected at 0, 3, and 24 h for all conditions except pepsin digestion and the SGF. For the latter two conditions, samples are obtained at 0, 1, and 3 h. Negative control samples are prepared for initial and final time points. A separate, positive activity control is run in parallel to test peptide. All samples are analyzed by LC/MS
Chymotrypsin 500 μl samples of 0.01 mg/mL peptide and guanylin (Sigma-Aldrich, G116; positive control) are prepared in the chymotrypsin reaction buffer (100 mM Tris-HCl, 10 mM CaCl$_2$, pH 7.5) in 2 mL eppendorf tubes. Zero and 24 h control samples are prepared by adding 5 μL of a 10 mM chymostatin (Sigma-Alrich, C7268; a chymotrypsin inhibitor) stock for a final concentration of 100 μM. All samples are incubated at 37° C. for 5 min. 20 μL of a 0.01 mg/mL chymotrypsin stock (α-chympotrypsin from bovine pancreas; Sigma-Aldrich, C6423) are added to each sample for a 0.0004 mg/mL final concentration. Samples are returned to the 37° C. water bath. The reaction is quenched with 5 μL of a 10 mM chymostatin stock at each time point for a final concentration of 100 μM. No extra chymostatin is added to the control samples as they already had inhibitor. Samples are subsequently flash frozen in liquid nitrogen, and stored at −80° C. until analysis. Upon analysis, samples are thawed and transferred to a 1 mL 96-well plate. Standards of peptide and guanylin are prepared in chymotrypsin reaction buffer at 0.625, 1.25, 2.50, 5.00, and 10.00 µg/mL concentrations. These standards are used to generate a standard curve for quantification of samples. When necessary, the standard curves are also used to calculate the concentration of the corresponding digestion product. 10 µL injections are made of each sample and standard.

Trypsin

500 µL samples of 0.01 mg/mL peptide and BAEE ($N_{alpha}$ Benzoyl-L-arginine ethyl ester hydrochloride; Sigma-Aldrich, B4500; positive control) are prepared with trypsin reaction buffer (100 mM Tris-HCl, pH 7.5) in 2 mL eppendorf tubes. Zero and 24 h time point control samples are prepared (N=1) with 5 µL of a 100 mg/mL AEBSF (4-(2-aminoethyl) benzenesulfonyl fluoride hydrochloride; a trypsin inhibitor) stock for a final concentration of 1 mg/mL. All control and test samples (0, 3, and 24 h) are incubated at 37° C. for 5 min. Twenty (20) µL of a 0.01 mg/mL trypsin (Sigma-Aldrich, T6467) stock are added to each sample for a final concentration of 0.0004 mg/mL. Samples are returned to the 37° C. water bath. The reaction is quenched with 5 µL of a 100 mg/mL AEBSF stock, which is added to each sample at the indicated timepoint, for a final concentration of 1 mg/mL. No extra AEBSF is added to the control samples as they already had inhibitor. Samples are subsequently flash frozen in liquid nitrogen, and stored at −80° C. until analysis. Upon analysis, samples are thawed and transferred to a 1 mL 96-well plate. Standards of peptide and BAEE are prepared in trypsin reaction buffer at 0.625, 1.25, 2.50, 5.00, and 10.00 µg/mL concentrations. These standards are used to generate a standard curve for quantification of samples. When necessary, the standard curves are also used to calculate the concentration of the corresponding digestion product. Ten (10) µL injections are made of each sample and standard.

Pepsin

500 µL samples of 100 U/mL pepsin (Pepsin porcine gastric mucosa; Sigma-Aldrich, P68871; U=release of 0.01 absorbance at 280 nM (A280) as TCA soluble hydrolysis products per min at 37° C. of hemoglobin) are prepared in the pepsin reaction buffer (100 mM HCl-KCl, pH 2.0) in 5 mL polystyrene round bottom tubes. To the control samples (0 and 24 h), 500 µL of a 1 M ammonium acetate (pepsin inhibitor) stock are added, for a final concentration of 0.5 M. All control and test samples (0, 1, and 3 h) are incubated at 37° C. for 5 min, while shaking. Fifty (50) µL of 0.1 mg/mL peptide and Insulin B chain, oxidized (Sigma-Aldrich, 16383; positive control), stocks are added to the respective tubes. Samples are returned to the 37° C. shaking water bath. Reactions are quenched by the addition of 500 µL of 1 M ammonium acetate for a final concentration of 0.5 M (except to the control samples, which already contained 0.5 M ammonium acetate). Samples are cooled on ice and stored at 4° C. until analysis. Upon analysis, samples are transferred to a 1 mL 96-well plate. Standards of peptide and Insulin B chain, oxidized, are prepared in 25 mM Tris-hydrochloric acid, 500 mM sodium chloride, pH 7.5 buffer at 0.625, 1.25, 2.50, 5.00, and 10.00 µg/mL concentrations. These standards are used to generate a standard curve for quantification of samples. Ten (10) µL injections are made of each sample and standard.

Aminopeptidase

500 µL samples of 0.01 mg/mL peptide and chemically synthesized wild type ST (positive control) are prepared in the aminopeptidase reaction buffer (5 mM Tris-HCl, 5 mM $MgCl_2$, pH 7.5) in 2 mL eppendorf tubes. 5 µL of a 5 mg/mL Bestatin hydrochloride (BioChemika, 08170; an aminopeptidase inhibitor) stock is added to each control sample (0 and 24 h), for a final concentration of 0.05 mg/mL. All control and test samples (0, 3, and 24 h) are incubated at 37° C. for 5 min. 0.02 U aminopeptidase (Aminopeptidase M, amino acid aryl amidase (Roche, 102768; U=hydrolysis of 1.0 umol of L-leucinamide to leucine and NH3 per min at pH 8.5 at 25° C.) are added to each sample. Samples are returned to the 37° C. water bath. The reaction is quenched with 5 µL of a 5 mg/mL Bestatin hydrochloride stock at the proper time point. No extra Bestatin hydrochloride is added to the control samples since they already had inhibitor present. Samples are subsequently flash frozen in liquid nitrogen, and stored at −80° C. until analysis. Upon analysis, samples are thawed and transferred to a 1 mL 96-well plate. Standards of peptide are prepared in aminopeptidase reaction buffer at 0.625, 1.25, 2.50, 5.00, and 10.00 µg/mL concentrations. These standards are used to generate a standard curve for quantification of samples. When necessary, the standard curves are also used to calculate the concentration of the corresponding digestion product. Ten (10) µL injections are made of each sample and standard.

Carboxypeptidase A

500 µL samples of 0.01 mg/mL peptide and N-CBZ-Glycine-Glycine-Leucine (Z-Gly-Gly-Leu; Sigma-Aldrich, C8501; positive control) are prepared in the carboxypeptidase A reaction buffer (25 mM Tris-HCl, 500 mM NaCl, pH 7.5) in 2 mL eppendorf tubes. Five (5) µL of a 40 µg/mL carboxypeptidase inhibitor (carboxypeptidase inhibitor from potato tuber (Sigma-Aldrich, C0279) stock is added to each control sample (0 and 24 h), for a final concentration of 0.4 µg/mL. All control and test (0, 3 and 24 h) samples are incubated at 37° C. for 5 min. Twenty $(20)_4$ of a 0.01 mg/mL carboxypeptidase A (Carboxypeptidase A from human pancreas; Sigma-Aldrich, C5358) stock is added to each sample. The samples are returned to the 37° C. water bath. The reaction is quenched with 5 µL of a 40 µg/mL carboxypeptidase inhibitor at the proper time point. No extra carboxypeptidase inhibitor is added to the control samples since there is already inhibitor present. Samples are subsequently flash frozen in liquid nitrogen, and stored at −80° C. until analysis. Upon analysis, samples are thawed and transferred to a 1 mL 96-well deep microtiter plate. Standards of peptide and Z-Gly-Gly-Leu are prepared in carboxypeptidase A reaction buffer at 0.625, 1.25, 2.50, 5.00, and 10.00 µg/mL concentrations. These standards are used to generate a standard curve for quantification of samples. When necessary, the standard curves are also used to calculate the concentration of the corresponding digestion product. Ten (10) µL injections are made of each sample and standard.

Carboxypeptidase A—Identification of Proteolysis Product

To analyze carboxypeptidase A digestion product, samples of 0.01 mg/mL peptide are prepared in the carboxypeptidase A reaction buffer at a total volume of 500 µL in 2 mL eppendorf tubes. Triplicate samples are prepared for the following time points: 0, 15, 30, 60, 120, 180 and 240 min. The samples are incubated at 37° C. for 5 min. Twenty (20) µL of a 0.01 mg/mL carboxypeptidase A stock are added to each sample and returned to the 37° C. water bath. The reactions are quenched with 5 µL, of a 40 µg/mL carboxypeptidase inhibitor at the proper time points. Samples are subsequently flash frozen in liquid nitrogen, and stored at −80° C. until analysis. Upon analysis, samples are thawed and transferred to a 1 mL 96-well plate. Standards of peptide prepared in carboxypeptidase A reaction buffer at 0.625, 1.25, 2.50, 5.00, and 10.00 µg/mL concentrations. These standards are used to generate a standard curve for quantification of samples. When necessary, the standard curves are also used to calculate the concentration of the corresponding digestion product. Ten (10) μL injections are made of each sample and standard. If the formation of a digestion product is evident, then a spectral analysis used to determine the mass of the digestion product, and predict its possible identity.

Simulated Gastric Fluid (SGF)

Samples of peptide are prepared in the simulated gastric fluid buffer (0.2% NaCl (w/v), 0.7% HCl (v/v), pH 1) to a total volume of 500 μL in 2 mL eppendorf tubes. The reference control and test samples (0, 1 and 3 h) are incubated at 37° C. for the time point indicated. The reference control sample is diluted 10-fold (1000 μL volume) in distilled water for a final concentration of 10 μM and chilled on ice. At each time point, samples are diluted 10-fold (1000 μL volume) in distilled water for an expected concentration of 10 UV, and chilled on ice, until analysis. Upon analysis, samples are transferred to a 1 mL 96-well plate. Standards of peptide are prepared in distilled water at 0.625, 1.25, 2.50, 5.00, and 10.00 μM concentrations. These standards are used to generate a standard curve for quantification of samples. Ten (10) μL injections are made of each sample and standard.

Example 7

Rodent Intestinal Transit Assays

In order to determine whether a peptide increases the rate of gastrointestinal transit, the peptide and controls are tested using a murine gastrointestinal transit (GIT) assay (Moon et al. *Infection and Immunity* 25:127, 1979). In this assay, charcoal, which can be readily visualized in the gastrointestinal tract, is administered to mice after the administration of a test compound. The distance traveled by the charcoal is measured and expressed as a percentage of the total length of the colon.

Mice are fasted with free access to water for 12 to 16 hours before the treatment with peptide or control buffer. The peptides are orally administered at 1 μg/kg-1 mg/kg of peptide in buffer (20 mM Tris pH 7.5) 7 minutes before being given an oral dose of 5% Activated Carbon (Aldrich 242276-250G). Control mice are administered buffer only before being given a dose of Activated Carbon. After 15 minutes, the mice are sacrificed and their intestines from the stomach to the cecum are dissected. The total length of the intestine as well as the distance traveled from the stomach to the charcoal front is measured for each animal and the results are expressed as the percent of the total length of the intestine traveled by the charcoal front. All results are reported as the average of 10 mice±standard deviation. A comparison of the distance traveled by the charcoal between the mice treated with peptide versus the mice treated with vehicle alone is performed using a Student's t test and a statistically significant difference is considered for P<0.05. P-values are calculated using a two-sided T-Test assuming unequal variances. Controls include vehicle alone (e.g. Tris buffer) and Zelnorm®.

An identical experiment can be performed to determine if peptides are effective in a chronic dosing treatment regimen. Briefly, 8 week old CD1 female mice are dosed orally once a day for 5 days with either peptide (0.06 mg/kg or 0.25 mg/kg in 20 mM Tris pH 7.5) or vehicle alone (20 mM Tris pH 7.5). On the $5^{th}$ day, a GIT assay is performed identical to that above except 200 μl of a 10% charcoal solution is administered.

The gastrointestinal transit assay can also performed in male and female CD rats (Charles River; Wilmington, Mass.). The assay is performed as described above for mice except an average of 5-8 animals are used for each test group and test peptide and 5% activated carbon are administered simultaneously (versus 7 minutes apart). In addition, the animals are sacrificed 10 minutes after the administration of peptide and test compound. The experiment can be performed in male and female rats.

The gastrointestinal transit assay can also performed in wild-type mice and mice lacking the guanylate cyclase C receptor (GC-C KO; Mann et al 1997 Biochem and Biophysical Research Communications 239:463). Wild type and GC-C KO mice are fasted overnight and test peptide or vehicle alone are orally administered 10 minutes prior to an oral dose of a 10% Activated Carbon/10% Gum Arabic suspension. Animals are sacrificed 5 minutes after peptide or vehicle administration.

Example 8

Intestinal Secretion Assay in Suckling Mice (SuMi Assay)

Peptides are tested for their ability to increase intestinal secretion using a suckling mouse model of intestinal secretion. In this model a test compound is administered to suckling mice that are between 7 and 9 days old. After the mice are sacrificed, the gastrointestinal tract from the stomach to the cecum is dissected ("guts"). The remains ("carcass") as well as the guts are weighed and the ratio of guts to carcass weight is calculated. If the ratio is above 0.09, one can conclude that the test compound increases intestinal secretion. Wild type ST peptide can be used as a control in this assay.

Example 9

Colonic Hyperalgesia Animal Models

Hypersensitivity to colorectal distension is common in patients with IBS and may be responsible for the major symptom of pain. Both inflammatory and non-inflammatory animal models of visceral hyperalgesia to distension have been developed to investigate the effect of compounds on visceral pain in IBS.

I. Trinitrobenzenesulphonic Acid (TNBS)-Induced Rectal Allodynia in Two Rodent Models TNBS Visceral Hypersensitivity Rat Model Male Wistar rats (220-250 g) are premedicated with 0.5 mg/kg of acepromazine injected intraperitoneally (IP) and anesthetized by intramuscular administration of 100 mg/kg of ketamine. Pairs of nichrome wire electrodes (60 cm in length and 80 μm in diameter) are implanted in the striated muscle of the abdomen, 2 cm laterally from the white line. The free ends of electrodes are exteriorized on the back of the neck and protected by a plastic tube attached to the skin. Electromyographic (EMG) recordings are started 5 days after surgery. Electrical activity of abdominal striated muscle is recorded with an electroencephalograph machine (Mini VIII, Alvar, Paris, France) using a short time constant (0.03 sec.) to remove low-frequency signals (<3 Hz).

Ten days post surgical implantation, trinitrobenzenesulphonic acid (TNBS) is administered to induce rectal inflammation. TNBS (80 mg kg$^{-1}$ in 0.3 ml 50% ethanol) is administered intrarectally through a silicone rubber catheter introduced at 3 cm from the anus under light diethyl-ether anesthesia, as previously described (Morteau et al. 1994 Dig Dis Sci 39:1239). Following TNBS administration, rats are placed in plastic tunnels where they are severely limited in mobility for several days before colorectal distension (CRD). Experimental compound is administered one hour before CRD which is performed by insertion into the rectum, at 1 cm of the anus, a 4 cm long balloon made from a latex condom (Gue et al, 1997 Neurogastroenterol. Motil. 9:271). The balloon is fixed on a rigid catheter taken from an embolectomy probe (Fogarty). The catheter attached balloon is fixed at the base of the tail. The balloon, connected to a barostat, is inflated progressively by steps of 15 mmHg, from 0 to 60 mmHg, each step of inflation lasting 5 min. Evaluation of rectal sensitivity, as measured by EMG, is performed before (1-2 days) and 3 days following rectal instillation of TNBS.

The number of spike bursts that corresponds to abdominal contractions is determined per 5 min periods. Statistical analysis of the number of abdominal contractions and evaluation of the dose-effects relationships is performed by a one way analysis of variance (ANOVA) followed by a post-hoc (Student or Dunnett tests) and regression analysis for ED50 if appropriate.

TNBS Visceral Hypersensitivity Model in Wild-Type (WT) Mice and Mice Lacking the Guanylate-Cyclase C Receptor (GC-C KO)

TNBS induced visceral hypersensitivity can be assessed in WT and GC-C KO mice. Two groups (WT and GC-C KO) of male mice (22-25 g) are surgically prepared for electromyographic (EMG) recordings. Three electrodes are implanted in the striated muscles of the abdomen for EMG recording of abdominal contractions. Colorectal distension (CRD) is performed with a balloon inflated by 10s steps of 0.02 ml from 0 to 0.12 ml. Under basal conditions mice are submitted to control CRD (time 0) followed by oral administration of test peptide (0.01 and 0.3 µg/kg) or vehicle only (distilled water, 1 ml) at 3 hours. One hour post dosing the CRD procedure is repeated. Abdominal EMG contractile response to colorectal distension in basal conditions in both WT and GC-C KO mice (12-14 mice per group) is determined in the absence of vehicle and test peptide, and the mean+/−standard error of the mean (SEM) are determined.

For TNBS induced visceral hypersensitivity conditions, mice are submitted to control CRD (time 0) and TNBS (20 mg/kg) is administered at 3 days. Three days post intracolonic TNBS-induction animals are orally administered test peptide (0.01 and 0.3 µg/kg) or vehicle (distilled water, 1 ml) 1 hour before CRD. The effect of test peptide (0.01 µg/kg) on abdominal response to colorectal distension after TNBS in WT and GC-C KO mice (12-14 per group) at a volume distension of 0.8 ml is determined and the mean+/−standard error of the mean (SEM) is determined.

II. Partial Restraint Stress-Induced Hyperalgesia Model

Five groups of female Wistar rats (weighing 200-250 g each), are surgically prepared for electromyography as described (Morteau et al. 1994 Dig Dis Sci 39:1239-48) and can be used to evaluate the effects of a test peptide on colorectal sensitivity and compliance after a 2 hour partial restraint stress session. Partial restraint stress (PRS), a relatively mild stress, is induced as previously described (Morteau et al. 1994 Dig Dis Sci 39:1239-48). Female rats are lightly anesthetized with diethyl ether and their shoulders, upper forelimbs and thoracic trunk are wrapped in a confining harness of paper tape to restrict, but not prevent body movements. Control sham-stress animals are anesthitized but not wrapped. Animals receive isobaric colorectal distensions (CRD) directly prior to (control CRD) and 15 minutes after two hours of partial restraint induced stress. Rats are treated orally with test peptide (0.3, 3, 30 ug/kg) or vehicle only (distilled water 1 mL) one hour before the CRD procedure. For the CRD procedure, rats are acclimatized to restraint in polypropylene tunnels (diameter: 7 cm; length: 20 cm) periodically for several days before CRD in order to minimize recording artifacts. The balloon used for distension is 4 cm long and made from a latex condom. It is fixed on a rigid catheter taken from an embolectomy probe (Fogarty). CRD is performed by insertion of the balloon in the rectum at 1 cm from the anus. The tube is fixed at the base of the tail. Isobaric distensions are performed from 0 to 60 mmHg, with each distension step lasting 5 minutes. The first distension is performed at a pressure of 15 mmHg and an increment of 15 mmHg is added at each following step, until a maximal pressure of 60 mmHg is attained. Electromyographic recordings commence 5 days after surgery. Electrical activity is recorded with an electroencephalograph (Mini VIII, Alvar, Paris, France) using a short time constant (0.03 sec.) to remove low-frequency signals (<3 Hz) and a paper speed of 3.6 cm/minute. Isobaric distensions of the colon are performed by connecting the balloon to a computerized barostat. Colonic pressure and balloon volume are continuously monitored on a potentiometric recorder (L6514, Linseis, Selb, Germany) with a paper speed of 1.0 cm/minute. The number of spike bursts, corresponding to abdominal contractions, is evaluated per 5-minute period. Colorectal volumes are determined as the maximal volume obtained for each stage of distension using the potentiometric recorder. Statistical analysis of these two parameters is performed using a one way analysis of variance (ANOVA) followed by an unpaired two-tailed Student's t test using GraphPad Prism 4.0. p values<0.05 are considered significantly different. The values are expressed as mean±SEM.

III. Water Avoidance Stress-Induced Hyperalgesia Model

The effect of peptides on basal visceral nociception can be tested using a model of water avoidance stress-induced visceral hyperalgesia in adult male Wistar rats. The stress involves confining rats to a platform surrounded by water for a period of 1 hour and then measuring their visceromotor response to colonic distension using electromyography (EMG).

At least 7 days prior to stress measurements, animals are deeply anesthetized with pentobarbital sodium (45 mg/kg) and equipped with electrodes implanted into the external oblique musculature, just superior to the inguinal ligament. Electrode leads are then tunneled subcutaneously and externalized laterally for future access. Following surgery, rats are housed in pairs and allowed to recover for at least 7 days. On the day of the experiment, animals are lightly anesthetized with halothane, and a lubricated latex balloon (6 cm) is inserted intra-anally into the descending colon. Animals are allowed to recover for 30 minutes, and colorectal distension (CRD) is initiated. The CRD procedure consists of graded intensities of phasic CRD (10, 20, 40, 60 mmHg; 20 s duration; 4 min inter-stimulus interval). Visceromotor response (VMR) to CRD is quantified by measuring EMG activity.

To determine the effect of a test peptide in a model of water avoidance stress-induced visceral hyperalgesia, a baseline CRD is recorded and then the animals are subjected to 1 hour of water avoidance stress. For water avoidance stress, the test apparatus consists of a Plexiglas tank with a block affixed to the center of the floor. The tank is filled with fresh room temperature water (25° C.) to within 1 cm of the top of the block. The animals are placed on the block for a period of 1 h. The sham water avoidance stress entails placing the rats on the same platform in a waterless container.

Phenylbenzoquinone-Induced Writhing Model

The PBQ-induced writhing model can be used to assess pain control activity of the peptides and GC-C receptor agonists. This model is described by Siegmund et al. (1957 Proc. Soc. Exp. Bio. Med. 95:729-731). Briefly, one hour after oral dosing with a test compound, e.g., a peptide, morphine or vehicle, 0.02% phenylbenzoquinone (PBQ) solution (12.5 mL/kg) is injected by intraperitoneal route into the mouse. The number of stretches and writhings are recorded from the $5^{th}$ to the $10^{th}$ minute after PBQ injection, and can also be counted between the $35^{th}$ and $40^{th}$ minute and between the $60^{th}$ and $65^{th}$ minute to provide a kinetic assessment. The results are expressed as the number of stretches and writhings (mean±SEM) and the percentage of variation of the nociceptive threshold calculated from the mean value of the vehicle-treated group. The statistical significance of any differences between the treated groups and the control group is determined by a Dunnett's test using the residual variance after a one-way analysis of variance (P<0.05) using SigmaStat Software.

Example 10

Measuring the Effect of Peptides on Bowel Habits

Single doses of 30, 100, 300, 1000 or 3000 µg of peptide are given to healthy males and postmenopausal females. At each dose level (peptide or placebo (vehicle) is administered orally in 5.0 mL 50 mM phosphate buffer (pH 6.0) plus 3×20 mL water rinses and 175 mL water after at least a 10-hour fast. In each dosing group, subjects are randomized to receive either placebo or peptide. Bowel habits (including Bristol Stool Form Scale score (BSFS), stool frequency, and stool weight) are evaluated for each collected bowel movement 48 hours prior to dose and up to approximately 48 hours postdose. The BSFS scale is as follows: (1) Separate hard lumps, like nuts; (2) Sausage-shaped but lumpy, (3) Like a sausage or snake but with cracks on its surface, (4) Like a sausage or snake, smooth and soft, (5) Soft blobs with clear-cut edges, (6) Fluffy pieces with ragged edges, a mushy stool, and (7) Watery, no solid pieces.

Example 11

Examination of the Effect of Peptides on the Consistency and Timing of Bowel Movements in Humans after a Seven-Day Dosing Period Seven daily doses of 30, 100, 300, or 1000 µg of peptide are given to healthy subjects. Peptide or placebo (vehicle) is administered orally in 5.0 mL 50 mM phosphate buffer (pH 6.0) plus 3×20 mL water rinses and 175 mL water after at least a 10-hour fast. In each dosing group, subjects are randomized to receive peptide or receive placebo. Daily mean BSFS scores, mean stool weight and mean ease of passage for the different dosing groups during the seven days prior to and the seven days during dosing with peptide are collected. The Mean Ease of Passage Scale is as follows: (1) Manual disimpaction, (2) Enema needed, (3) Straining needed, (4) Normal, (5) Urgent without pain, (6) Urgent with pain, and (7) Incontinent.

Example 12

Peptide Effects in a Rat Model of Postoperative Ileus

Female CD rats are used to test the effect of peptide on delayed transit induced by abdominal surgery and manual manipulation of the small intestine. Groups of at least nine rats undergo abdominal surgery under isoflurane anesthesia. Surgery consists of laparotomy and 5 minutes of gentle manual intestinal massage. Following recovery from anesthesia, rats are dosed orally with either 10 µg/kg peptide 3 or vehicle (20 mM Tris) in a volume of 300 µl. 1 hour after dosing, intestinal transit rate is measured. Animals are again dosed with 300 µl of the peptide followed immediately by 500 µl of a charcoal meal (10% charcoal, 10% gum arabic in water). To calculate the distance of the small intestine traveled by the charcoal front, after 20 minutes, the total length of the intestine as well as the distance traveled from the stomach to the charcoal front are measured for each animal.

Example 13

Peptide Effect on cGMP Levels and Secretion in Ligated Loops Rodent Models

The effect of peptide on cGMP levels and secretion are studied by injecting peptide directly into an isolated loop in either wild-type or GC-C KO mice. This done by surgically ligating a loop in the small intestine of the mouse. The methodology for ligated loop formation is a similar to that described in London et al. 1997 Am J Physiol p. G93-105. The loop is roughly centered and is a length of 1-3 cm. The loops are injected with 100 µl of either peptide (5 µg) or vehicle (20 mM Tris, pH 7.5 or Krebs Ringer, 10 mM Glucose, HEPES buffer (KRGH)). Following a recovery time of 90 minutes the loops are excised. Weights are recorded for each loop before and after removal of the fluid contained therein. The length of each loop is also recorded. A weight to length ratio (W/L) for each loop is calculated to determine the effects of peptide on secretion.

To determine the effect of peptide on cGMP activity, fluid from the loop is collected in ice-cold trichloracetic acid (TCA) and stored at −80° C. for use in an assay to measure cGMP levels in the fluid. Intestinal fluid samples are TCA extracted, and cyclic GMP is measured by EIA according to procedures outlined in the Cayman Chemical Cyclic GMP EIA kit (Cayman Chemical, Ann Arbor, Mich.) to determine cyclic GMP levels in the intestinal fluid of the mouse in the presence of either peptide or vehicle. The effects of peptide on cGMP levels and secretion in ligated loops in female CD rats can also be determined using protocols similar to those described above. In the case of the rat, however four loops of intestine are surgically ligated. The first three loops are distributed equally in the small intestine and the fourth loop is located in colon. Loops are 1 to 3 centimeters, and are injected with 2004 of either peptide (5 µg) or vehicle (Krebs Ringer, 10 mM glucose, HEPES buffer (KRGH)).

Example 14

Peptide Effects on Opioid Induced Constipation

The effect of peptide on opioid induced constipation is studied by dosing female rats (~160 g each) with 300 µl of the opiate, morphine (2.5 mg/kg) via intra-peritoneal injection. Thirty minutes post dosing, animals are treated with 300 µl of SEQ ID NO:3 or vehicle only. Ten minutes later, the animals are orally dosed with 500 µl 10% charcoal, 10% gum arabic meal. After ten minutes, the animals are sacrificed and gastrointestinal transit is measured as in Example 3 above.

Example 15

Mass Spectrometry Characterization of Disulfide Bonds in Peptide

The position of disulfide bonds in a test peptide can be determined as follows. To identify the optimal conditions required to partially reduce a test peptide, chemically synthesized peptide is alkylated with iodoacetamide after TCEP (tris(2-carboxyethyl) phosphine) treatment (0.1 to 10 mM for 20 minutes at room temperature). After TCEP reduction, the reaction is adjusted to pH 8.0 with Tris and iodoacetamide is added to 50 mM. The reaction products are analyzed by LC-MS. Partially reduced peptide is then cyanylated, cleaved with base and completely reduced to separate fragments. After partial reduction, both cyanylation and cleavage of peptide are performed either in a test tube or in an HPLC column. A modified method of Wu and Watson ((2002) *Methods Mol. Biol.* 194: 1-22) is used to determine the position of the disulfide bonds. The steps are carried out manually, with isolation of the alkylation products by solid phase extraction (SPE), or in-line (automated), with reactions occurring in an SPE column. Briefly, the manual procedure comprised the following. Chemically synthesized peptide is partially reduced with 1 mM tris(2-carboxyethyl) phosphine (TCEP) at pH 3. The sulfhydryl groups of partially reduced peptide are cyanylated with 2.1 μmoles of 1-cyano-4-dimethylaminopyridinium tetrafluoroborate (CDAP) for 15 minutes. The reaction mixture is then diluted to 0.5 mL with 10 mM ammonium acetate pH 5.8 and applied to an Amprep octadecyl C18 minicolumn (100 mg, GE HealthTech). The minicolumn is washed with 1 mL of 10 mM ammonium acetate pH 5.8 and peptides eluted with 0.6 mL methanol. After drying, the peptides are cleaved in 1 M NH4OH and fully reduced with 0.1 M TCEP. After drying, the peptide fragments are reconstituted in 0.1% formic acid and analyzed by LC-MS. Briefly, the automated procedure comprised the following. Peptide is loaded onto an Oasis HLB 2×15 mm column (Waters). Reactions are carried out by filling a 5 mL sample loop with 1.2 mM TCEP, 2.4 mM CDAP, 2 M NH$_4$OH or 6 mM TCEP and pushing each reagent through the column with 0.1% formic acid in 5% methanol at a flow rate of 0.3 mL/min. The column is then back-flushed and the cleaved peptides analyzed by LC-MS.

LC-MS analysis can be conduced using an Atlantis dC18 2.1×50 mm column (Waters) equilibrated in 98% buffer A (0.1% formic acid), 2% buffer B (0.1% formic acid: 85% methanol, 15% CH3CN) at a flow rate of 0.3 mL/min. After a 4 min wash with the same buffers, peptides are eluted with a linear gradient of 2% buffer B to 40% buffer B over 38 min with a constant flow rate of 0.3 mL/min. Cleaved peptide masses are determined using a Micromass Q-T of II instrument equipped with an electrospray ionization (ESI) source operating in positive ion mode. The instrument is programmed to scan in the mass range of m/z 100 to 1000. Molecular weight predictions and data analysis are carried out with MassLynx version 4.0 software. Based on the method of Wu and Watson (supra), a list of possible fragments resulting from CN-induced cleavage of singly reduced and cyanylated species of peptide with all possible disulfide linkage combinations is generated. The list included the signature fragments for each possible structure and is used to predict the disulfide bonding pattern of the test peptide.

PEGylated Peptides

The in vivo half-life of peptides can be extended by conjugating the peptide to a water soluble polymer, such as polyethylene glycol (PEG) to create a PEGylated peptide. The polyethylene glycol molecules are usually connected to the peptide via a reactive group found on the peptide, e.g., an amino group found within a lysine or at the amino terminus of the peptide.

Various methods are known for attaching polyethylene glycol to a peptide (see, for example, U.S. Pat. No. 4,002,531; U.S. Pat. No. 4,904,584; U.S. Pat. No. 5,834,594; U.S. Pat. No. 5,824,784 and U.S. Pat. No. 5,985,265).

Administration of Peptides and GC-C Receptor Agonists

For therapeutic and preventive treatment of disorders described herein, the peptides and agonists described herein can be administered orally, e.g., as a tablet or cachet containing a predetermined amount of the active ingredient, pellet, gel, paste, syrup, bolus, electuary, slurry, sachet; capsule; powder; lyophilized powder; granules; as a solution or a suspension in an aqueous liquid or a non-aqueous liquid; as an oil-in-water liquid emulsion or a water-in-oil liquid emulsion, via a liposomal formulation (see, e.g., EP 736299) or in some other form. Orally administered compositions can include binders, lubricants, inert diluents, lubricating, surface active or dispersing agents, flavoring agents, and humectants. Orally administered formulations such as tablets may optionally be coated or scored and may be formulated so as to provide sustained, delayed or controlled release of the active ingredient therein. The peptides and agonists can be co-administered with other agents used to treat gastrointestinal disorders including but not limited to the agents described herein. The peptides and agonists can also be administered by rectal suppository. For the treatment of disorders outside the gastrointestinal tract such as congestive heart failure and benign prostatic hypertrophy, peptides and agonists are preferably administered parenterally or orally.

The peptides described herein can be administered alone or in combination with other agents. For example, the peptides can be administered together with an analgesic peptide or compound. The analgesic peptide or compound can be covalently attached to a peptide described herein or it can be a separate agent that is administered together with or sequentially with a peptide described herein in a combination therapy.

Combination therapy can be achieved by administering two or more agents, e.g., a peptide described herein and an analgesic peptide or compound, each of which is formulated and administered separately, or by administering two or more agents in a single formulation. Other combinations are also encompassed by combination therapy. For example, two agents can be formulated together and administered in conjunction with a separate formulation containing a third agent. While the two or more agents in the combination therapy can be administered simultaneously, they need not be. For example, administration of a first agent (or combination of agents) can precede administration of a second agent (or combination of agents) by minutes, hours, days, or weeks. Thus, the two or more agents can be administered within minutes of each other or within 1, 2, 3, 6, 9, 12, 15, 18, or 24 hours of each other or within 1, 2, 3, 4, 5, 6, 7, 8, 9, 10, 12, 14 days of each other or within 2, 3, 4, 5, 6, 7, 8, 9, or 10 weeks of each other. In some cases even longer intervals are possible. While in many cases it is desirable that the two or more agents used in a combination therapy be present in within the patient's body at the same time, this need not be so.

Combination therapy can also include two or more administrations of one or more of the agents used in the combination. For example, if agent X and agent Y are used in a combination, one could administer them sequentially in any combination one or more times, e.g., in the order X-Y-X, X-X-Y, Y-X-Y, Y-Y-X, X-X-Y-Y, etc.

Combination therapy can also include the administration of two or more agents via different routes or locations. For example, (a) one agent is administered orally and another agent is administered intravenously or (b) one agent is administered orally and another is administered locally. In each case, the agents can either simultaneously or sequentially.

Approximated dosages for some of the combination therapy agents described herein are found in the "BNF Recommended Dose" column of tables on pages 11-17 of WO01/76632 (the data in the tables being attributed to the March 2000 British National Formulary) and can also be found in other standard formularies and other drug prescribing directories. For some drugs, the customary prescribed dose for an indication will vary somewhat from country to country.

The agents, alone or in combination, can be combined with any pharmaceutically acceptable carrier or medium. Thus, they can be combined with materials that do not produce an adverse, allergic or otherwise unwanted reaction when administered to a patient. The carriers or mediums used can include solvents, dispersants, coatings, absorption promoting agents, controlled release agents, and one or more inert excipients (which include starches, polyols, granulating agents, microcrystalline cellulose (e.g. celphere, Celphere Beads®), diluents, lubricants, binders, disintegrating agents, and the like), etc. If desired, tablet dosages of the disclosed compositions may be coated by standard aqueous or non-aqueous techniques.

Compositions of the present disclosure may also optionally include other therapeutic ingredients, anti-caking agents, preservatives, sweetening agents, colorants, flavors, desiccants, plasticizers, dyes, glidants, anti-adherents, anti-static agents, surfactants (wetting agents), anti-oxidants, film-coating agents, and the like. Any such optional ingredient must be compatible with the compound described herein to insure the stability of the formulation.

The composition may contain other additives as needed, including for example lactose, glucose, fructose, galactose, trehalose, sucrose, maltose, raffinose, maltitol, melezitose, stachyose, lactitol, palatinite, starch, xylitol, mannitol, myo-inositol, and the like, and hydrates thereof, and amino acids, for example alanine, glycine and betaine, and peptides and proteins, for example albumen.

Examples of excipients for use as the pharmaceutically acceptable carriers and the pharmaceutically acceptable inert carriers and the aforementioned additional ingredients include, but are not limited to binders, fillers, disintegrants, lubricants, anti-microbial agents, and coating agents such as:

BINDERS: corn starch, potato starch, other starches, gelatin, natural and synthetic gums such as acacia, xanthan, sodium alginate, alginic acid, other alginates, powdered tragacanth, guar gum, cellulose and its derivatives (e.g., ethyl cellulose, cellulose acetate, carboxymethyl cellulose calcium, sodium carboxymethyl cellulose), polyvinyl pyrrolidone (e.g., povidone, crospovidone, copovidone, etc), methyl cellulose, Methocel, pre-gelatinized starch (e.g., STARCH 1500® and STARCH 1500 LM®, sold by Colorcon, Ltd.), hydroxypropyl methyl cellulose, microcrystalline cellulose (e.g. AVICEL™, such as, AVICEL-PH-101™, -103™ and -105™, sold by FMC Corporation, Marcus Hook, Pa., USA), or mixtures thereof, FILLERS: talc, calcium carbonate (e.g., granules or powder), dibasic calcium phosphate, tribasic calcium phosphate, calcium sulfate (e.g., granules or powder), microcrystalline cellulose, powdered cellulose, dextrates, kaolin, mannitol, silicic acid, sorbitol, starch, pre-gelatinized starch, dextrose, fructose, honey, lactose anhydrate, lactose monohydrate, lactose and aspartame, lactose and cellulose, lactose and microcrystalline cellulose, maltodextrin, maltose, mannitol, microcrystalline cellulose & guar gum, molasses, sucrose, or mixtures thereof, DISINTEGRANTS: agar-agar, alginic acid, calcium carbonate, microcrystalline cellulose, croscarmellose sodium, crospovidone, polacrilin potassium, sodium starch glycolate, potato or tapioca starch, other starches, pre-gelatinized starch, clays, other algins, other celluloses, gums (like gellan), low-substituted hydroxypropyl cellulose, or mixtures thereof, LUBRICANTS: calcium stearate, magnesium stearate, mineral oil, light mineral oil, glycerin, sorbitol, mannitol, polyethylene glycol, other glycols, stearic acid, sodium lauryl sulfate, sodium stearyl fumarate, vegetable based fatty acids lubricant, talc, hydrogenated vegetable oil (e.g., peanut oil, cottonseed oil, sunflower oil, sesame oil, olive oil, corn oil and soybean oil), zinc stearate, ethyl oleate, ethyl laurate, agar, syloid silica gel (AEROSIL 200, W.R. Grace Co., Baltimore, Md. USA), a coagulated aerosol of synthetic silica (Deaussa Co., Plano, Tex. USA), a pyrogenic silicon dioxide (CAB-O-SIL, Cabot Co., Boston, Mass. USA), or mixtures thereof, ANTI-CAKING AGENTS: calcium silicate, magnesium silicate, silicon dioxide, colloidal silicon dioxide, talc, or mixtures thereof, ANTIMICROBIAL AGENTS: benzalkonium chloride, benzethonium chloride, benzoic acid, benzyl alcohol, butyl paraben, cetylpyridinium chloride, cresol, chlorobutanol, dehydroacetic acid, ethylparaben, methylparaben, phenol, phenylethyl alcohol, phenoxyethanol, phenylmercuric acetate, phenylmercuric nitrate, potassium sorbate, propylparaben, sodium benzoate, sodium dehydro acetate, sodium propionate, sorbic acid, thimersol, thymo, or mixtures thereof, and COATING AGENTS: sodium carboxymethyl cellulose, cellulose acetate phthalate, ethylcellulose, gelatin, pharmaceutical glaze, hydroxypropyl cellulose, hydroxypropyl methylcellulose (hypromellose), hydroxypropyl methyl cellulose phthalate, methylcellulose, polyethylene glycol, polyvinyl acetate phthalate, shellac, sucrose, titanium dioxide, carnauba wax, microcrystalline wax, gellan gum, maltodextrin, methacrylates, microcrystalline cellulose and carrageenan or mixtures thereof.

The formulation can also include other excipients and categories thereof including but not limited to L-histidine, Pluronic®, Poloxamers (such as Lutrol® and Poloxamer 188), ascorbic acid, glutathione, permeability enhancers (e.g. lipids, sodium cholate, acylcarnitine, salicylates, mixed bile salts, fatty acid micelles, chelators, fatty acid, surfactants, medium chain glycerides), protease inhibitors (e.g. soybean trypsin inhibitor, organic acids), pH lowering agents and absorption enhancers effective to promote bioavailability (including but not limited to those described in U.S. Pat. No. 6,086,918 and U.S. Pat. No. 5,912,014), creams and lotions (like maltodextrin and carrageenans); materials for chewable tablets (like dextrose, fructose, lactose monohydrate, lactose and aspartame, lactose and cellulose, maltodextrin, maltose, mannitol, microcrystalline cellulose and guar gum, sorbitol crystalline); parenterals (like mannitol and povidone); plasticizers (like dibutyl sebacate, plasticizers for coatings, polyvinylacetate phthalate); powder lubricants (like glyceryl behenate); soft gelatin capsules (like sorbitol special solution); spheres for coating (like sugar spheres); spheronization agents (like glyceryl behenate and microcrystalline cellulose); suspending/gelling agents (like carrageenan, gellan gum, mannitol, microcrystalline cellulose, povidone, sodium starch glycolate, xanthan gum); sweeteners (like aspartame, aspartame and lactose, dextrose, fructose, honey, maltodextrin, maltose, mannitol, molasses, sorbitol crystalline, sorbitol special solution, sucrose); wet granulation agents (like calcium carbonate, lactose anhydrous, lactose monohydrate, maltodextrin, mannitol, microcrystalline cellulose, povidone, starch), caramel, carboxymethylcellulose sodium, cherry cream flavor and cherry flavor, citric acid anhydrous, citric acid, confectioner's sugar, D&C Red No. 33, D&C Yellow #10 Aluminum Lake, disodium edetate, ethyl alcohol 15%, FD& C Yellow No. 6 aluminum lake, FD&C Blue #1 Aluminum Lake, FD&C Blue No. 1, FD&C blue no. 2 aluminum lake, FD&C Green No. 3, FD&C Red No. 40, FD&C Yellow No. 6 Aluminum Lake, FD&C Yellow No. 6, FD&C Yellow No. 10, glycerol palmitostearate, glyceryl monostearate, indigo carmine, lecithin, manitol, methyl and propyl parabens, mono ammonium glycyrrhizinate, natural and artificial orange flavor, pharmaceutical glaze, poloxamer 188, Polydextrose, polysorbate 20, polysorbate 80, polyvidone, pregelatinized corn starch, pregelatinized starch, red iron oxide, saccharin sodium, sodium carboxymethyl ether, sodium chloride, sodium citrate, sodium phosphate, strawberry flavor, synthetic black iron oxide, synthetic red iron oxide, titanium dioxide, and white wax.

Solid oral dosage forms may optionally be treated with coating systems (e.g. Opadry® fx film coating system, for example Opadry® blue (OY-LS-20921), Opadry® white (YS-2-7063), Opadry® white (YS-1-7040), and black ink (S-1-8106).

The agents either in their free form or as a salt can be combined with a polymer such as polylactic-glycoloic acid (PLGA), poly-(I)-lactic-glycolic-tartaric acid (P(I)LGT) (WO 01/12233), polyglycolic acid (U.S. Pat. No. 3,773,919), polylactic acid (U.S. Pat. No. 4,767,628), poly(M-caprolactone) and poly(alkylene oxide) (U.S. 20030068384) to create a sustained release formulation. Such formulations can be used to implants that release a peptide or another agent over a period of a few days, a few weeks or several months depending on the polymer, the particle size of the polymer, and the size of the implant (see, e.g., U.S. Pat. No. 6,620,422). Other sustained release formulations and polymers for use in are described in EP 0 467 389 A2, WO 93/24150, U.S. Pat. No. 5,612,052, WO 97/40085, WO 03/075887, WO 01/01964A2, U.S. Pat. No. 5,922,356, WO 94/155587, WO 02/074247A2, WO 98/25642, U.S. Pat. No. 5,968,895, U.S. Pat. No. 6,180,608, U.S. 20030171296, U.S. 20020176841, U.S. Pat. No. 5,672,659, U.S. Pat. No. 5,893,985, U.S. Pat. No. 5,134,122, U.S. Pat. No. 5,192,741, U.S. Pat. No. 5,192,741, U.S. Pat. No. 4,668,506, U.S. Pat. No. 4,713,244, U.S. Pat. No. 5,445,832 U.S. Pat. No. 4,931,279, U.S. Pat. No. 5,980,945, WO 02/058672, WO 9726015, WO 97/04744, and. US20020019446. In such sustained release formulations microparticles (Delie and Blanco-Prieto 2005 Molecule 10:65-80) of peptide are combined with microparticles of polymer. One or more sustained release implants can be placed in the large intestine, the small intestine or both. U.S. Pat. No. 6,011,011 and WO 94/06452 describe a sustained release formulation providing either polyethylene glycols (i.e. PEG 300 and PEG 400) or triacetin. WO 03/053401 describes a formulation which may both enhance bioavailability and provide controlled release of the agent within the GI tract. Additional controlled release formulations are described in U.S. Pat. No. 6,734,188, WO 02/38129, EP 326 151, U.S. Pat. No. 5,236,704, WO 02/30398, WO 98/13029; U.S. 20030064105, U.S. 20030138488A1, U.S. 20030216307A1, U.S. Pat. No. 6,667,060, WO 01/49249, WO 01/49311, WO 01/49249, WO 01/49311, and U.S. Pat. No. 5,877,224.

The agents can be administered, e.g., by intravenous injection, intramuscular injection, subcutaneous injection, intraperitoneal injection, topical, sublingual, intraarticular (in the joints), intradermal, buccal, ophthalmic (including intraocular), intranasaly (including using a cannula), intraspinally, intrathecally, or by other routes. The agents can be administered orally, e.g., as a tablet or cachet containing a predetermined amount of the active ingredient, gel, pellet, paste, syrup, bolus, electuary, slurry, capsule, powder, lyophilized powder, granules, sachet, as a solution or a suspension in an aqueous liquid or a non-aqueous liquid, as an oil-in-water liquid emulsion or a water-in-oil liquid emulsion, via a micellar formulation (see, e.g. WO 97/11682) via a liposomal formulation (see, e.g., EP 736299, WO 99/59550 and WO 97/13500), via formulations described in WO 03/094886, via bilosome (bile-salt based vesicular system), via a dendrimer, or in some other form. Orally administered compositions can include binders, lubricants, inert diluents, lubricating, surface active or dispersing agents, flavoring agents, and humectants. Orally administered formulations such as tablets may optionally be coated or scored and may be formulated so as to provide sustained, delayed or controlled release of the active ingredient therein. The agents can also be administered transdermally (i.e. via reservoir-type or matrix-type patches, microneedles, thermal poration, hypodermic needles, iontophoresis, electroporation, ultrasound or other forms of sonophoresis, jet injection, or a combination of any of the preceding methods (Prausnitz et al. 2004, Nature Reviews Drug Discovery 3:115-124)). The agents can be administered using high-velocity transdermal particle injection techniques using the hydrogel particle formulation described in U.S. 20020061336. Additional particle formulations are described in WO 00/45792, WO 00/53160, and WO 02/19989. An example of a transdermal formulation containing plaster and the absorption promoter dimethylisosorbide can be found in WO 89/04179. WO 96/11705 provides formulations suitable for transdermal administration. The agents can be administered in the form a suppository or by other vaginal or rectal means. The agents can be administered in a transmembrane formulation as described in WO 90/07923. The agents can be administered non-invasively via the dehydrated particles described in U.S. Pat. No. 6,485,706. The agent can be administered in an enteric-coated drug formulation as described in WO 02/49621. The agents can be administered intranassaly using the formulation described in U.S. Pat. No. 5,179,079. Formulations suitable for parenteral injection are described in WO 00/62759. The agents can be administered using the casein formulation described in U.S. 20030206939 and WO 00/06108. The agents can be administered using the particulate formulations described in U.S. 20020034536.

The agents, alone or in combination with other suitable components, can be administered by pulmonary route utilizing several techniques including but not limited to intratracheal instillation (delivery of solution into the lungs by syringe), intratracheal delivery of liposomes, insufflation (administration of powder formulation by syringe or any other similar device into the lungs) and aerosol inhalation. Aerosols (e.g., jet or ultrasonic nebulizers, metered-dose inhalers (MDIs), and dry-powder inhalers (DPIs)) can also be used in intranasal applications. Aerosol formulations are stable dispersions or suspensions of solid material and liquid droplets in a gaseous medium and can be placed into pressurized acceptable propellants, such as hydrofluoroalkanes (HFAs, i.e. HFA-134a and HFA-227, or a mixture thereof), dichlorodifluoromethane (or other chlorofluocarbon propellants such as a mixture of Propellants 11, 12, and/or 114), propane, nitrogen, and the like. Pulmonary formulations may include permeation enhancers such as fatty acids, saccharides, chelating agents, enzyme inhibitors (e.g., protease inhibitors), adjuvants (e.g., glycocholate, surfactin, span 85, and nafamostat), preservatives (e.g., benzalkonium chloride or chlorobutanol), and ethanol (normally up to 5% but possibly up to 20%, by weight). Ethanol is commonly included in aerosol compositions as it can improve the function of the metering valve and in some cases also improve the stability of the dispersion. Pulmonary formulations may also include surfactants which include but are not limited to bile salts and those described in U.S. Pat. No. 6,524,557 and references therein. The surfactants described in U.S. Pat. No. 6,524,557, e.g., a C8-C16 fatty acid salt, a bile salt, a phospholipid, or alkyl saccaride are advantageous in that some of them also reportedly enhance absorption of the peptide in the formulation. Also suitable in the disclosure are dry powder formulations comprising a therapeutically effective amount of active compound blended with an appropriate carrier and adapted for use in connection with a dry-powder inhaler. Absorption enhancers which can be added to dry powder formulations of the present disclosure include those described in U.S. Pat. No. 6,632,456. WO 02/080884 describes new methods for the surface modification of powders. Aerosol formulations may include U.S. Pat. No. 5,230,884, U.S. Pat. No. 5,292,499, WO 017/8694, WO 01/78696, U.S. 2003019437, U.S. 20030165436, and WO 96/40089 (which includes vegetable oil). Sustained release formulations suitable for inhalation are described in U.S. 20010036481A1, 20030232019A1, and U.S. 20040018243A1 as well as in WO 01/13891, WO 02/067902, WO 03/072080, and WO 03/079885. Pulmonary formulations containing microparticles are described in WO 03/015750, U.S. 20030008013, and WO 00/00176. Pulmonary formulations containing stable glassy state powder are described in U.S. 20020141945 and U.S. Pat. No. 6,309,671. Other aerosol formulations are described in EP 1338272A1 WO 90/09781, U.S. Pat. No. 5,348,730, U.S. Pat. No. 6,436,367, WO 91/04011, and U.S. Pat. No. 6,294,153 and U.S. Pat. No. 6,290,987 describes a liposomal based formulation that can be administered via aerosol or other means. Powder formulations for inhalation are described in U.S. 20030053960 and WO 01/60341. The agents can be administered intranasally as described in U.S. 20010038824. The agents can be incorporated into microemulsions, which generally are thermodynamically stable, isotropically clear dispersions of two immiscible liquids, such as oil and water, stabilized by an interfacial film of surfactant molecules (Encyclopedia of Pharmaceutical Technology (New York: Marcel Dekker, 1992), volume 9). For the preparation of microemulsions, surfactant (emulsifier), co-surfactant (co-emulsifier), an oil phase and a water phase are necessary. Suitable surfactants include any surfactants that are useful in the preparation of emulsions, e.g., emulsifiers that are typically used in the preparation of creams. The co-surfactant (or "co-emulsifer") is generally selected from the group of polyglycerol derivatives, glycerol derivatives and fatty alcohols. Preferred emulsifier/co-emulsifier combinations are generally although not necessarily selected from the group consisting of: glyceryl monostearate and polyoxyethylene stearate; polyethylene glycol and ethylene glycol palmitostearate; and caprilic and capric triglycerides and oleoyl macrogolglycerides. The water phase includes not only water but also, typically, buffers, glucose, propylene glycol, polyethylene glycols, preferably lower molecular weight polyethylene glycols (e.g., PEG 300 and PEG 400), and/or glycerol, and the like, while the oil phase will generally comprise, for example, fatty acid esters, modified vegetable oils, silicone oils, mixtures of mono- di- and triglycerides, mono- and di-esters of PEG (e.g., oleoyl macrogol glycerides), etc.

The agents described herein can be incorporated into pharmaceutically-acceptable nanoparticle, nanosphere, and nanocapsule formulations (Delie and Blanco-Prieto 2005 Molecule 10:65-80). Nanocapsules can generally entrap compounds in a stable and reproducible way (Henry-Michelland et al., 1987; Quintanar-Guerrero et al., 1998; Douglas et al., 1987). To avoid side effects due to intracellular polymeric overloading, ultrafine particles (sized around 0.1 µm) can be designed using polymers able to be degraded in vivo (e.g. biodegradable polyalkyl-cyanoacrylate nanoparticles). Such particles are described in the prior art (Couvreur et al, 1980; 1988; zur Muhlen et al., 1998; Zambaux et al. 1998; Pinto-Alphandry et al., 1995 and U.S. Pat. No. 5,145,684).

The agents described herein can be formulated with pH sensitive materials which may include those described in WO04041195 (including the seal and enteric coating described therein) and pH-sensitive coatings that achieve delivery in the colon including those described in U.S. Pat. No. 4,910,021 and WO9001329. U.S. Pat. No. 4,910,021 describes using a pH-sensitive material to coat a capsule. WO9001329 describes using pH-sensitive coatings on beads containing acid, where the acid in the bead core prolongs dissolution of the pH-sensitive coating. U.S. Pat. No. 5,175,003 discloses a dual mechanism polymer mixture composed of pH-sensitive enteric materials and film-forming plasticizers capable of conferring permeability to the enteric material, for use in drug-delivery systems; a matrix pellet composed of a dual mechanism polymer mixture permeated with a drug and sometimes covering a pharmaceutically neutral nucleus; a membrane-coated pellet comprising a matrix pellet coated with a dual mechanism polymer mixture envelope of the same or different composition; and a pharmaceutical dosage form containing matrix pellets. The matrix pellet releases acid-soluble drugs by diffusion in acid pH and by disintegration at pH levels of nominally about 5.0 or higher. The agents described herein may be formulated in the pH triggered targeted control release systems described in WO04052339. The agents described herein may be formulated according to the methodology described in any of WO03105812 (extruded hyrdratable polymers); WO0243767 (enzyme cleavable membrane translocators); WO03007913 and WO03086297 (mucoadhesive systems); WO02072075 (bilayer laminated formulation comprising pH lowering agent and absorption enhancer); WO04064769 (amidated peptides); WO05063156 (solid lipid suspension with pseudotropic and/or thixotropic properties upon melting); WO03035029 and WO03035041 (erodible, gastric retentive dosage forms); U.S. Pat. No. 5,007,790 and U.S. Pat. No. 5,972,389 (sustained release dosage forms); WO04112711 (oral extended release compositions); WO05027878, WO02072033, and WO02072034 (delayed release compositions with natural or synthetic gum); WO05030182 (controlled release formulations with an ascending rate of release); WO05048998 (microencapsulation system); U.S. Pat. No. 5,952,314 (biopolymer); U.S. Pat. No. 5,108,758 (glassy amylose matrix delivery); U.S. Pat. No. 5,840,860 (modified starch based delivery). JP10324642 (delivery system comprising chitosan and gastric resistant material such as wheat gliadin or zein); U.S. Pat. No. 5,866,619 and U.S. Pat. No. 6,368,629 (saccharide containing polymer); U.S. Pat. No. 6,531,152 (describes a drug delivery system containing a water soluble core (Ca pectinate or other water-insoluble polymers) and outer coat which bursts (eg hydrophobic polymer-Eudragrit)); U.S. Pat. No. 6,234,464; U.S. Pat. No. 6,403,130 (coating with polymer containing casein and high methoxy pectin; WO0174175 (Maillard reaction product); WO05063206 (solubility increasing formulation); WO04019872 (transferring fusion proteins). The agents described herein may be formulated using gastrointestinal retention system technology (GIRES; Merrion Pharmaceuticals). GIRES comprises a controlled-release dosage form inside an inflatable pouch, which is placed in a drug capsule for oral administration. Upon dissolution of the capsule, a gas-generating system inflates the pouch in the stomach where it is retained for 16-24 hours, all the time releasing agents described herein.

The agents described herein can be formulated in an osmotic device including the ones disclosed in U.S. Pat. No. 4,503,030, U.S. Pat. No. 5,609,590 and U.S. Pat. No. 5,358, 502. U.S. Pat. No. 4,503,030 discloses an osmotic device for dispensing a drug to certain pH regions of the gastrointestinal tract. More particularly, the disclosure relates to an osmotic device comprising a wall formed of a semi-permeable pH sensitive composition that surrounds a compartment containing a drug, with a passageway through the wall connecting the exterior of the device with the compartment. The device delivers the drug at a controlled rate in the region of the gastrointestinal tract having a pH of less than 3.5, and the device self-destructs and releases all its drug in the region of the gastrointestinal tract having a pH greater than 3.5, thereby providing total availability for drug absorption. U.S. Pat. Nos. 5,609,590 and 5,358,502 disclose an osmotic bursting device for dispensing a beneficial agent to an aqueous environment. The device comprises a beneficial agent and osmagent surrounded at least in part by a semi-permeable membrane. The beneficial agent may also function as the osmagent. The semi-permeable membrane is permeable to water and substantially impermeable to the beneficial agent and osmagent. A trigger means is attached to the semi-permeable membrane (e.g., joins two capsule halves). The trigger means is activated by a pH of from 3 to 9 and triggers the eventual, but sudden, delivery of the beneficial agent. These devices enable the pH-triggered release of the beneficial agent core as a bolus by osmotic bursting.

The agents described herein may be formulated based on the disclosure described in U.S. Pat. No. 5,316,774 which discloses a composition for the controlled release of an active substance comprising a polymeric particle matrix, where each particle defines a network of internal pores. The active substance is entrapped within the pore network together with a blocking agent having physical and chemical characteristics selected to modify the release rate of the active substance from the internal pore network. In one embodiment, drugs may be selectively delivered to the intestines using an enteric material as the blocking agent. The enteric material remains intact in the stomach but degrades under the pH conditions of the intestines. In another embodiment, the sustained release formulation employs a blocking agent, which remains stable under the expected conditions of the environment to which the active substance is to be released. The use of pH-sensitive materials alone to achieve site-specific delivery is difficult because of leaking of the beneficial agent prior to the release site or desired delivery time and it is difficult to achieve long time lags before release of the active ingredient after exposure to high pH (because of rapid dissolution or degradation of the pH-sensitive materials).

The agents may also be formulated in a hybrid system which combines pH-sensitive materials and osmotic delivery systems. These hybrid devices provide delayed initiation of sustained-release of the beneficial agent. In one device a pH-sensitive matrix or coating dissolves releasing osmotic devices that provide sustained release of the beneficial agent see U.S. Pat. Nos. 4,578,075, 4,681,583, and 4,851,231. A second device consists of a semipermeable coating made of a polymer blend of an insoluble and a pH-sensitive material. As the pH increases, the permeability of the coating increases, increasing the rate of release of beneficial agent see U.S. Pat. Nos. 4,096,238, 4,503,030, 4,522, 625, and 4,587,117.

The agents described herein may be formulated in terpolumers according to U.S. Pat. No. 5,484,610 which discloses terpolymers which are sensitive to pH and temperature which are useful carriers for conducting bioactive agents through the gastric juices of the stomach in a protected form. The terpolymers swell at the higher physiologic pH of the intestinal tract causing release of the bioactive agents into the intestine. The terpolymers are linear and are made up of 35 to 99 wt % of a temperature sensitive component, which imparts to the terpolymer LCST (lower critical solution temperature) properties below body temperatures, 1 to 30 wt % of a pH sensitive component having a pKa in the range of from 2 to 8 which functions through ionization or deionization of carboxylic acid groups to prevent the bioactive agent from being lost at low pH but allows bioactive agent release at physiological pH of about 7.4 and a hydrophobic component which stabilizes the LCST below body temperatures and compensates for bioactive agent effects on the terpolymers. The terpolymers provide for safe bioactive agent loading, a simple procedure for dosage form fabrication and the terpolymer functions as a protective carrier in the acidic environment of the stomach and also protects the bioactive agents from digestive enzymes until the bioactive agent is released in the intestinal tract.

The agents described herein may be formulated in pH sensitive polymers according to those described in U.S. Pat. No. 6,103,865. U.S. Pat. No. 6,103,865 discloses pH-sensitive polymers containing sulfonamide groups, which can be changed in physical properties, such as swellability and solubility, depending on pH and which can be applied for a drug-delivery system, bio-material, sensor, and the like, and a preparation method therefore. The pH-sensitive polymers are prepared by introduction of sulfonamide groups, various in pKa, to hydrophilic groups of polymers either through coupling to the hydrophilic groups of polymers, such as acrylamide, N,N-dimethylacrylamide, acrylic acid, N-isopropylacrylamide and the like or copolymerization with other polymerizable monomers. These pH-sensitive polymers may have a structure of linear polymer, grafted copolymer, hydrogel or interpenetrating network polymer.

The agents described herein may be formulated according U.S. Pat. No. 5,656,292 which discloses a composition for pH dependent or pH regulated controlled release of active ingredients especially drugs. The composition consists of a compactable mixture of the active ingredient and starch molecules substituted with acetate and dicarboxylate residues. The preferred dicarboxylate acid is succinate. The average substitution degree of the acetate residue is at least 1 and 0.2-1.2 for the dicarboxylate residue. The starch molecules can have the acetate and dicarboxylate residues attached to the same starch molecule backbone or attached to separate starch molecule backbones. The present disclosure also discloses methods for preparing said starch acetate dicarboxylates by transesterification or mixing of starch acetates and starch dicarboxylates respectively.

The agents described herein may be formulated according to the methods described in U.S. Pat. Nos. 5,554,147, 5,788, 687, and 6,306,422 which disclose a method for the controlled release of a biologically active agent wherein the agent is released from a hydrophobic, pH-sensitive polymer matrix. The polymer matrix swells when the environment reaches pH 8.5, releasing the active agent. A polymer of hydrophobic and weakly acidic comonomers is disclosed for use in the controlled release system. Also disclosed is a specific embodiment in which the controlled release system may be used. The pH-sensitive polymer is coated onto a latex catheter used in ureteral catheterization. A ureteral catheter coated with a pH-sensitive polymer having an antibiotic or urease inhibitor trapped within its matrix will release the active agent when exposed to high pH urine.

The agents described herein may be formulated in/with bioadhesive polymers according to U.S. Pat. No. 6,365,187. Bioadhesive polymers in the form of, or as a coating on, microcapsules containing drugs or bioactive substances which may serve for therapeutic, or diagnostic purposes in diseases of the gastrointestinal tract, are described in U.S. Pat. No. 6,365,187. The polymeric microspheres all have a bioadhesive force of at least 11 mN/cm$^2$ (110 N/m2) Techniques for the fabrication of bioadhesive microspheres, as well as a method for measuring bioadhesive forces between microspheres and selected segments of the gastrointestinal tract in vitro are also described. This quantitative method provides a means to establish a correlation between the chemical nature, the surface morphology and the dimensions of drug-loaded microspheres on one hand and bioadhesive forces on the other, allowing the screening of the most promising materials from a relatively large group of natural and synthetic polymers which, from theoretical consideration, should be used for making bioadhesive microspheres. Solutions of medicament in buffered saline and similar vehicles are commonly employed to generate an aerosol in a nebulizer. Simple nebulizers operate on Bernoulli's principle and employ a stream of air or oxygen to generate the spray particles. More complex nebulizers employ ultrasound to create the spray particles. Both types are well known in the art and are described in standard textbooks of pharmacy such as Sprowls' American Pharmacy and Remington's The Science and Practice of Pharmacy. Other devices for generating aerosols employ compressed gases, usually hydrofluorocarbons and chlorofluorocarbons, which are mixed with the medicament and any necessary excipients in a pressurized container, these devices are likewise described in standard textbooks such as Sprowls and Remington.

The agents can be a free acid or base, or a pharmacologically acceptable salt thereof. Solids can be dissolved or dispersed immediately prior to administration or earlier. In some circumstances the preparations include a preservative to prevent the growth of microorganisms. The pharmaceutical forms suitable for injection can include sterile aqueous or organic solutions or dispersions which include, e.g., water, an alcohol, an organic solvent, an oil or other solvent or dispersant (e.g., glycerol, propylene glycol, polyethylene glycol, and vegetable oils). The formulations may contain antioxidants, buffers, bacteriostats, and solutes that render the formulation isotonic with the blood of the intended recipient, and aqueous and non-aqueous sterile suspensions that can include suspending agents, solubilizers, thickening agents, stabilizers, and preservatives. Pharmaceutical agents can be sterilized by filter sterilization or by other suitable means. The agent can be fused to immunoglobulins or albumin, albumin variants or fragments thereof, or incorporated into a liposome to improve half-life. Thus the peptides described herein may be fused directly or via a peptide linker, water soluble polymer, or prodrug linker to albumin or an analog, fragment, or derivative thereof. Generally, the albumin proteins that are part of the fusion proteins of the present disclosure may be derived from albumin cloned from any species, including human. Human serum albumin (HSA) consists of a single non-glycosylated peptide chain of 585 amino acids with a formula molecular weight of 66,500. The amino acid sequence of human HSA is known [See Meloun, et al. (1975) FEBS Letters 58:136; Behrens, et al. (1975) Fed. Proc. 34:591; Lawn, et al. (1981) Nucleic Acids Research 9:6102-6114; Minghetti, et al. (1986) J. Biol. Chem. 261:6747, each of which are incorporated by reference herein]. A variety of polymorphic variants as well as analogs and fragments of albumin have been described. [See Weitkamp, et al., (1973) Ann. Hum. Genet. 37:219]. For example, in EP 322,094, various shorter forms of HSA. Some of these fragments of HSA are disclosed, including HSA(1-373), HSA(1-388), HSA(1-389), HSA(1-369), and HSA(1-419) and fragments between 1-369 and 1-419. EP 399,666 discloses albumin fragments that include HSA(1-177) and HSA(1-200) and fragments between HSA(1-177) and HSA(1-200). Methods related to albumin fusion proteins can be found in U.S. Pat. No. 7,056,701, U.S. Pat. No. 6,994,857, U.S. Pat. No. 6,946, 134, U.S. Pat. No. 6,926,898, and U.S. Pat. No. 6,905,688 and the related priority documents and references cited therein. The agent can also be conjugated to polyethylene glycol (PEG) chains. Methods for pegylation and additional formulations containing PEG-conjugates (i.e. PEG-based hydrogels, PEG modified liposomes) can be found in Harris and Chess, Nature Reviews Drug Discovery 2: 214-221 and the references therein. Peptides can also be modified with alkyl groups (e.g., C1-C20 straight or branched alkyl groups); fatty acid radicals; and combinations of PEG, alkyl groups and fatty acid radicals (see U.S. Pat. No. 6,309,633; Soltero et al., 2001 Innovations in Pharmaceutical Technology 106-110). The agent can be administered via a nanocochleate or cochleate delivery vehicle (BioDelivery Sciences International). The agents can be delivered transmucosally (i.e. across a mucosal surface such as the vagina, eye or nose) using formulations such as that described in U.S. Pat. No. 5,204,108. The agents can be formulated in microcapsules as described in WO 88/01165. The agent can be administered intra-orally using the formulations described in U.S. 20020055496, WO 00/47203, and U.S. Pat. No. 6,495,120. The agent can be delivered using nanoemulsion formulations described in WO 01/91728A2.

Controlled Release Formulations

In general, one can provide for controlled release of the agents described herein through the use of a wide variety of polymeric carriers and controlled release systems including erodible and non-erodible matrices, osmotic control devices, various reservoir devices, enteric coatings and multiparticulate control devices.

Matrix devices are a common device for controlling the release of various agents. In such devices, the agents described herein are generally present as a dispersion within the polymer matrix, and are typically formed by the compression of a polymer/drug mixture or by dissolution or melting. The dosage release properties of these devices may be dependent upon the solubility of the agent in the polymer matrix or, in the case of porous matrices, the solubility in the sink solution within the pore network, and the tortuosity of the network. In one instance, when utilizing an erodible polymeric matrix, the matrix imbibes water and forms an aqueous-swollen gel that entraps the agent. The matrix then gradually erodes, swells, disintegrates or dissolves in the GI tract, thereby controlling release of one or more of the agents described herein. In non-erodible devices, the agent is released by diffusion through an inert matrix.

Agents described herein can be incorporated into an erodible or non-erodible polymeric matrix controlled release device. By an erodible matrix is meant aqueous-erodible or water-swellable or aqueous-soluble in the sense of being either erodible or swellable or dissolvable in pure water or requiring the presence of an acid or base to ionize the polymeric matrix sufficiently to cause erosion or dissolution. When contacted with the aqueous environment of use, the erodible polymeric matrix imbibes water and forms an aqueous-swollen gel or matrix that entraps the agent described herein. The aqueous-swollen matrix gradually erodes, swells, disintegrates or dissolves in the environment of use, thereby controlling the release of a compound described herein to the environment of use.

The erodible polymeric matrix into which an agent described herein can be incorporated may generally be described as a set of excipients that are mixed with the agent following its formation that, when contacted with the aqueous environment of use imbibes water and forms a water-swollen gel or matrix that entraps the drug form. Drug release may occur by a variety of mechanisms, for example, the matrix may disintegrate or dissolve from around particles or granules of the agent or the agent may dissolve in the imbibed aqueous solution and diffuse from the tablet, beads or granules of the device. One ingredient of this water-swollen matrix is the water-swellable, erodible, or soluble polymer, which may generally be described as an osmopolymer, hydrogel or water-swellable polymer. Such polymers may be linear, branched, or crosslinked. The polymers may be homopolymers or copolymers. In certain embodiments, they may be synthetic polymers derived from vinyl, acrylate, methacrylate, urethane, ester and oxide monomers. In other embodiments, they can be derivatives of naturally occurring polymers such as polysaccharides (e.g. chitin, chitosan, dextran and pullulan; gum agar, gum arabic, gum karaya, locust bean gum, gum tragacanth, carrageenans, gum ghatti, guar gum, xanthan gum and scleroglucan), starches (e.g. dextrin and maltodextrin), hydrophilic colloids (e.g. pectin), phosphatides (e.g. lecithin), alginates (e.g. ammonium alginate, sodium, potassium or calcium alginate, propylene glycol alginate), gelatin, collagen, and cellulosics. Cellulosics are cellulose polymer that has been modified by reaction of at least a portion of the hydroxyl groups on the saccharide repeat units with a compound to form an ester-linked or an ether-linked substituent. For example, the cellulosic ethyl cellulose has an ether linked ethyl substituent attached to the saccharide repeat unit, while the cellulosic cellulose acetate has an ester linked acetate substituent. In certain embodiments, the cellulosics for the erodible matrix comprises aqueous-soluble and aqueous-erodible cellulosics can include, for example, ethyl cellulose (EC), methylethyl cellulose (MEC), carboxymethyl cellulose (CMC), CMEC, hydroxyethyl cellulose (HEC), hydroxypropyl cellulose (HPC), cellulose acetate (CA), cellulose propionate (CP), cellulose butyrate (CB), cellulose acetate butyrate (CAB), CAP, CAT, hydroxypropyl methyl cellulose (HPMC), HPMCP, HPMCAS, hydroxypropyl methyl cellulose acetate trimellitate (HPMCAT), and ethylhydroxy ethylcellulose (EHEC). In certain embodiments, the cellulosics comprises various grades of low viscosity (MW less than or equal to 50,000 daltons, for example, the Dow Methocel™ series E5, E15LV, E50LV and K100LY) and high viscosity (MW greater than 50,000 daltons, for example, E4MCR, E10MCR, K4M, K15M and K100M and the Methocel™ K series) HPMC. Other commercially available types of HPMC include the Shin Etsu Metolose 90SH series. The choice of matrix material can have a large effect on the maximum drug concentration attained by the device as well as the maintenance of a high drug concentration. The matrix material can be a concentration-enhancing polymer, for example, as described in WO05/011634.

Other materials useful as the erodible matrix material include, but are not limited to, pullulan, polyvinyl pyrrolidone, polyvinyl alcohol, polyvinyl acetate, glycerol fatty acid esters, polyacrylamide, polyacrylic acid, copolymers of ethacrylic acid or methacrylic acid (EUDRAGITO, Rohm America, Inc., Piscataway, N.J.) and other acrylic acid derivatives such as homopolymers and copolymers of butylmethacrylate, methylmethacrylate, ethylmethacrylate, ethylacrylate, (2-dimethylaminoethyl) methacrylate, and (trimethylaminoethyl) methacrylate chloride.

The erodible matrix polymer may contain a wide variety of the same types of additives and excipients known in the pharmaceutical arts, including osmopolymers, osmagens, solubility-enhancing or -retarding agents and excipients that promote stability or processing of the device.

Alternatively, the agents of the present disclosure may be administered by or incorporated into a non-erodible matrix device. In such devices, an agent described herein is distributed in an inert matrix. The agent is released by diffusion through the inert matrix. Examples of materials suitable for the inert matrix include insoluble plastics (e.g methyl acrylate-methyl methacrylate copolymers, polyvinyl chloride, polyethylene), hydrophilic polymers (e.g. ethyl cellulose, cellulose acetate, crosslinked polyvinylpyrrolidone (also known as crospovidone)), and fatty compounds (e.g. carnauba wax, microcrystalline wax, and triglycerides). Such devices are described further in Remington: The Science and Practice of Pharmacy, 20th edition (2000).

Matrix controlled release devices may be prepared by blending an agent described herein and other excipients together, and then forming the blend into a tablet, caplet, pill, or other device formed by compressive forces. Such compressed devices may be formed using any of a wide variety of presses used in the fabrication of pharmaceutical devices. Examples include single-punch presses, rotary tablet presses, and multilayer rotary tablet presses, all well known in the art. See for example, Remington: The Science and Practice of Pharmacy, 20th Edition, 2000. The compressed device may be of any shape, including round, oval, oblong, cylindrical, or triangular. The upper and lower surfaces of the compressed device may be flat, round, concave, or convex.

In certain embodiments, when formed by compression, the device has a strength of at least 5 Kiloponds (Kp)/cm$^2$ (for example, at least 7 Kp/cm$^2$). Strength is the fracture force, also known as the tablet hardness required to fracture a tablet formed from the materials, divided by the maximum cross-sectional area of the tablet normal to that force. The fracture force may be measured using a Schleuniger Tablet Hardness Tester, Model 6D. The compression force required to achieve this strength will depend on the size of the tablet, but generally will be greater than about 5 kP/cm$^2$. Friability is a well-know measure of a device's resistance to surface abrasion that measures weight loss in percentage after subjecting the device to a standardized agitation procedure. Friability values of from 0.8 to 1.0% are regarded as constituting the upper limit of acceptability. Devices having a strength of greater than 5 kP/cm$^2$ generally are very robust, having a friability of less than 0.5%. Other methods for forming matrix controlled-release devices are well known in the pharmaceutical arts. See for example, Remington: The Science and Practice of Pharmacy, 20th Edition, 2000.

As noted above, the agents described herein may also be incorporated into an osmotic control device. Such devices generally include a core containing one or more agents as described herein and a water permeable, non-dissolving and non-eroding coating surrounding the core which controls the influx of water into the core from an aqueous environment of use so as to cause drug release by extrusion of some or all of the core to the environment of use. In certain embodiments, the coating is polymeric, aqueous-permeable, and has at least one delivery port. The core of the osmotic device optionally includes an osmotic agent which acts to imbibe water from the surrounding environment via such a semi-permeable membrane. The osmotic agent contained in the core of this device may be an aqueous-swellable hydrophilic polymer or it may be an osmogen, also known as an osmagent. Pressure is generated within the device which forces the agent(s) out of the device via an orifice (of a size designed to minimize solute diffusion while preventing the build-up of a hydrostatic pressure head).

Osmotic agents create a driving force for transport of water from the environment of use into the core of the device. Osmotic agents include but are not limited to water-swellable hydrophilic polymers, and osmogens (or osmagens). Thus, the core may include water-swellable hydrophilic polymers, both ionic and nonionic, often referred to as osmopolymers and hydrogels. The amount of water-swellable hydrophilic polymers present in the core may range from about 5 to about 80 wt % (including for example, 10 to 50 wt %). Nonlimiting examples of core materials include hydrophilic vinyl and acrylic polymers, polysaccharides such as calcium alginate, polyethylene oxide (PEO), polyethylene glycol (PEG), polypropylene glycol (PPG), poly (2-hydroxyethyl methacrylate), poly (acrylic) acid, poly (methacrylic) acid, polyvinylpyrrolidone (PVP) and crosslinked PVP, polyvinyl alcohol (PVA), PVA/PVP copolymers and PVA/PVP copolymers with hydrophobic monomers such as methyl methacrylate, vinyl acetate, and the like, hydrophilic polyurethanes containing large PEO blocks, sodium croscarmellose, carrageenan, hydroxyethyl cellulose (HEC), hydroxypropyl cellulose (HPC), hydroxypropyl methyl cellulose (HPMC), carboxymethyl cellulose (CMC) and carboxyethyl cellulose (CEC), sodium alginate, polycarbophil, gelatin, xanthan gum, and sodium starch glycolat. Other materials include hydrogels comprising interpenetrating networks of polymers that may be formed by addition or by condensation polymerization, the components of which may comprise hydrophilic and hydrophobic monomers such as those just mentioned. Water-swellable hydrophilic polymers include but are not limited to PEO, PEG, PVP, sodium croscarmellose, HPMC, sodium starch glycolate, polyacrylic acid and crosslinked versions or mixtures thereof.

The core may also include an osmogen (or osmagent). The amount of osmogen present in the core may range from about 2 to about 70 wt % (including, for example, from 10 to 50 wt %). Typical classes of suitable osmogens are water-soluble organic acids, salts and sugars that are capable of imbibing water to thereby effect an osmotic pressure gradient across the barrier of the surrounding coating. Typical useful osmogens include but are not limited to magnesium sulfate, magnesium chloride, calcium chloride, sodium chloride, lithium chloride, potassium sulfate, sodium carbonate, sodium sulfite, lithium sulfate, potassium chloride, sodium sulfate, mannitol, xylitol, urea, sorbitol, inositol, raffinose, sucrose, glucose, fructose, lactose, citric acid, succinic acid, tartaric acid, and mixtures thereof. In certain embodiments, the osmogen is glucose, lactose, sucrose, mannitol, xylitol, sodium chloride, including combinations thereof.

The core may include a wide variety of additives and excipients that enhance the performance of the dosage form or that promote stability, tableting or processing. Such additives and excipients include tableting aids, surfactants, water-soluble polymers, pH modifiers, fillers, binders, pigments, disintegrants, antioxidants, lubricants and flavorants. Nonlimiting examples of additives and excipients include but are not limited to those described elsewhere herein as well as microcrystalline cellulose, metallic salts of acids (e.g. aluminum stearate, calcium stearate, magnesium stearate, sodium stearate, zinc stearate), pH control agents (e.g. buffers, organic acids, organic acid salts, organic and inorganic bases), fatty acids, hydrocarbons and fatty alcohols (e.g. stearic acid, palmitic acid, liquid paraffin, stearyl alcohol, and palmitol), fatty acid esters (e.g. glyceryl (mono- and di-) stearates, triglycerides, glyceryl (palmiticstearic) ester, sorbitan esters (e.g. sorbitan monostearate, saccharose monostearate, saccharose monopalmitate, sodium stearyl fumarate), polyoxyethylene sorbitan esters), surfactants (e.g. alkyl sulfates (e.g. sodium lauryl sulfate, magnesium lauryl sulfate), polymers (e.g. polyethylene glycols, polyoxyethylene glycols, polyoxyethylene, polyoxypropylene ethers, including copolymers thereof), polytetrafluoroethylene), and inorganic materials (e.g. talc, calcium phosphate), cyclodextrins, sugars (e.g. lactose, xylitol), sodium starch glycolate). Nonlimiting examples of disintegrants are sodium starch glycolate (e.g., Explotab™ CLV, (microcrystalline cellulose (e.g., Avicel™), microcrystalline silicified cellulose (e.g., ProSolv™), croscarmellose sodium (e.g., Ac-Di-Sol™). When the agent described herein is a solid amorphous dispersion formed by a solvent process, such additives may be added directly to the spray-drying solution when forming an agent described herein/concentration-enhancing polymer dispersion such that the additive is dissolved or suspended in the solution as a slurry, Alternatively, such additives may be added following the spray-drying process to aid in forming the final controlled release device.

A nonlimiting example of an osmotic device consists of one or more drug layers containing an agent described herein, such as a solid amorphous drug/polymer dispersion, and a sweller layer that comprises a water-swellable polymer, with a coating surrounding the drug layer and sweller layer. Each layer may contain other excipients such as tableting aids, osmagents, surfactants, water-soluble polymers and water-swellable polymers.

Such osmotic delivery devices may be fabricated in various geometries including bilayer (wherein the core comprises a drug layer and a sweller layer adjacent to each other), trilayer (wherein the core comprises a sweller layer sandwiched between two drug layers) and concentric (wherein the core comprises a central sweller agent surrounded by the drug layer). The coating of such a tablet comprises a membrane permeable to water but substantially impermeable to drug and excipients contained within. The coating contains one or more exit passageways or ports in communication with the drug-containing layer(s) for delivering the drug agent. The drug-containing layer(s) of the core contains the drug agent (including optional osmagents and hydrophilic water-soluble polymers), while the sweller layer consists of an expandable hydrogel, with or without additional osmotic agents.

When placed in an aqueous medium, the tablet imbibes water through the membrane, causing the agent to form a dispensable aqueous agent, and causing the hydrogel layer to expand and push against the drug-containing agent, forcing the agent out of the exit passageway. The agent can swell, aiding in forcing the drug out of the passageway. Drug can be delivered from this type of delivery system either dissolved or dispersed in the agent that is expelled from the exit passageway.

The rate of drug delivery is controlled by such factors as the permeability and thickness of the coating, the osmotic pressure of the drug-containing layer, the degree of hydrophilicity of the hydrogel layer, and the surface area of the device. Those skilled in the art will appreciate that increasing the thickness of the coating will reduce the release rate, while any of the following will increase the release rate: increasing the permeability of the coating; increasing the hydrophilicity of the hydrogel layer; increasing the osmotic pressure of the drug-containing layer; or increasing the device's surface area.

Other materials useful in forming the drug-containing agent, in addition to the agent described herein itself, include HPMC, PEO and PVP and other pharmaceutically acceptable carriers. In addition, osmagents such as sugars or salts, including but not limited to sucrose, lactose, xylitol, mannitol, or sodium chloride, may be added. Materials which are useful for forming the hydrogel layer include sodium CMC, PEO (e.g. polymers having an average molecular weight from about 5,000,000 to about 7,500,000 daltons), poly (acrylic acid), sodium (polyacrylate), sodium croscarmellose, sodium starch glycolat, PVP, crosslinked PVP, and other high molecular weight hydrophilic materials.

In the case of a bilayer geometry, the delivery port(s) or exit passageway(s) may be located on the side of the tablet containing the drug agent or may be on both sides of the tablet or even on the edge of the tablet so as to connect both the drug layer and the sweller layer with the exterior of the device. The exit passageway(s) may be produced by mechanical means or by laser drilling, or by creating a difficult-to-coat region on the tablet by use of special tooling during tablet compression or by other means.

The osmotic device can also be made with a homogeneous core surrounded by a semipermeable membrane coating, as in U.S. Pat. No. 3,845,770. The agent described herein can be incorporated into a tablet core and a semipermeable membrane coating can be applied via conventional tablet-coating techniques such as using a pan coater. A drug delivery passageway can then be formed in this coating by drilling a hole in the coating, either by use of a laser or mechanical means. Alternatively, the passageway may be formed by rupturing a portion of the coating or by creating a region on the tablet that is difficult to coat, as described above. In one embodiment, an osmotic device comprises: (a) a single-layer compressed core comprising: (i) an agent described herein, (ii) a hydroxyethylcellulose, and (iii) an osmagent, wherein the hydroxyethylcellulose is present in the core from about 2.0% to about 35% by weight and the osmagent is present from about 15% to about 70% by weight; (b) a water-permeable layer surrounding the core; and (c) at least one passageway within the water-permeable layer (b) for delivering the drug to a fluid environment surrounding the tablet. In certain embodiments, the device is shaped such that the surface area to volume ratio (of a water-swollen tablet) is greater than 0.6 mm$^{-1}$ (including, for example, greater than 1.0 mm$^{-1}$). The passageway connecting the core with the fluid environment can be situated along the tablet body area. In certain embodiments, the shape is an oblong shape where the ratio of the tablet tooling axes, i.e., the major and minor axes which define the shape of the tablet, are between 1.3 and 3 (including, for example, between 1.5 and 2.5). In one embodiment, the combination of the agent described herein and the osmagent have an average ductility from about 100 to about 200 Mpa, an average tensile strength from about 0.8 to about 2.0 Mpa, and an average brittle fracture index less than about 0.2. The single-layer core may optionally include a disintegrant, a bioavailability enhancing additive, and/or a pharmaceutically acceptable excipient, carrier or diluent.

In certain embodiments, entrainment of particles of agents described herein in the extruding fluid during operation of such osmotic device is desirable. For the particles to be well entrained, the agent drug form is dispersed in the fluid before the particles have an opportunity to settle in the tablet core. One means of accomplishing this is by adding a disintegrant that serves to break up the compressed core into its particulate components. Nonlimiting examples of standard disintegrants include materials such as sodium starch glycolate (e.g., Explotab™ CLV), microcrystalline cellulose (e.g., Avicel™), microcrystalline silicified cellulose (e.g., ProSolv™) and croscarmellose sodium (e.g., Ac-Di-Sol™), and other disintegrants known to those skilled in the art. Depending upon the particular formulation, some disintegrants work better than others. Several disintegrants tend to form gels as they swell with water, thus hindering drug delivery from the device. Non-gelling, non-swelling disintegrants provide a more rapid dispersion of the drug particles within the core as water enters the core. In certain embodiments, non-gelling, non-swelling disintegrants are resins, for example, ion-exchange resins. In one embodiment, the resin is Amberlite™ IRP 88 (available from Rohm and Haas, Philadelphia, Pa.). When used, the disintegrant is present in amounts ranging from about 50-74% of the core agent.

Water-soluble polymers are added to keep particles of the agent suspended inside the device before they can be delivered through the passageway(s) (e.g., an orifice). High viscosity polymers are useful in preventing settling. However, the polymer in combination with the agent is extruded through the passageway(s) under relatively low pressures. At a given extrusion pressure, the extrusion rate typically slows with increased viscosity. Certain polymers in combination with particles of the agent described herein form high viscosity solutions with water but are still capable of being extruded from the tablets with a relatively low force. In contrast, polymers having a low weight-average, molecular weight (<about 300,000) do not form sufficiently viscous solutions inside the tablet core to allow complete delivery due to particle settling. Settling of the particles is a problem when such devices are prepared with no polymer added, which leads to poor drug delivery unless the tablet is constantly agitated to keep the particles from settling inside the core. Settling is also problematic when the particles are large and/or of high density such that the rate of settling increases.

In certain embodiments, the water-soluble polymers for such osmotic devices do not interact with the drug. In certain embodiments the water-soluble polymer is a non-ionic polymer. A nonlimiting example of a non-ionic polymer forming solutions having a high viscosity yet still extrudable at low pressures is Natrosol™ 250H (high molecular weight hydroxyethylcellulose, available from Hercules Incorporated, Aqualon Division, Wilmington, Del.; MW equal to about 1 million daltons and a degree of polymerization equal to about 3,700). Natrosol 250H™ provides effective drug delivery at concentrations as low as about 3% by weight of the core when combined with an osmagent. Natrosol 250H™ NF is a high-viscosity grade nonionic cellulose ether that is soluble in hot or cold water. The viscosity of a 1% solution of Natrosol 250H using a Brookfield LVT (30 rpm) at 25° C. is between about 1,500 and about 2,500 cps.

In certain embodiments, hydroxyethylcellulose polymers for use in these monolayer osmotic tablets have a weight-average, molecular weight from about 300,000 to about 1.5 million. The hydroxyethylcellulose polymer is typically present in the core in an amount from about 2.0% to about 35% by weight.

Another example of an osmotic device is an osmotic capsule. The capsule shell or portion of the capsule shell can be semipermeable. The capsule can be filled either by a powder or liquid consisting of an agent described herein, excipients that imbibe water to provide osmotic potential, and/or a water-swellable polymer, or optionally solubilizing excipients. The capsule core can also be made such that it has a bilayer or multilayer agent analogous to the bilayer, trilayer or concentric geometries described above.

Another class of osmotic device useful in this disclosure comprises coated swellable tablets, for example, as described in EP378404. Coated swellable tablets comprise a tablet core comprising an agent described herein and a swelling material, preferably a hydrophilic polymer, coated with a membrane, which contains holes, or pores through which, in the aqueous use environment, the hydrophilic polymer can extrude and carry out the agent. Alternatively, the membrane may contain polymeric or low molecular weight water-soluble porosigens. Porosigens dissolve in the aqueous use environment, providing pores through which the hydrophilic polymer and agent may extrude. Examples of porosigens are water-soluble polymers such as HPMC, PEG, and low molecular weight compounds such as glycerol, sucrose, glucose, and sodium chloride. In addition, pores may be formed in the coating by drilling holes in the coating using a laser or other mechanical means. In this class of osmotic devices, the membrane material may comprise any film-forming polymer, including polymers which are water permeable or impermeable, providing that the membrane deposited on the tablet core is porous or contains water-soluble porosigens or possesses a macroscopic hole for water ingress and drug release. Embodiments of this class of sustained release devices may also be multilayered, as described, for example, in EP378404.

When an agent described herein is a liquid or oil, such as a lipid vehicle formulation, for example as described in WO05/011634, the osmotic controlled-release device may comprise a soft-gel or gelatin capsule formed with a composite wall and comprising the liquid formulation where the wall comprises a barrier layer formed over the external surface of the capsule, an expandable layer formed over the barrier layer, and a semipermeable layer formed over the expandable layer. A delivery port connects the liquid formulation with the aqueous use environment. Such devices are described, for example, in U.S. Pat. No. 6,419,952, U.S. Pat. No. 6,342,249, U.S. Pat. No. 5,324,280, U.S. Pat. No. 4,672,850, U.S. Pat. No. 4,627,850, U.S. Pat. No. 4,203,440, and U.S. Pat. No. 3,995,631.

The osmotic controlled release devices of the present disclosure can also comprise a coating. In certain embodiments, the osmotic controlled release device coating exhibits one or more of the following features: is water-permeable, has at least one port for the delivery of drug, and is non-dissolving and non-eroding during release of the drug formulation, such that drug is substantially entirely delivered through the delivery port(s) or pores as opposed to delivery primarily via permeation through the coating material itself. Delivery ports include any passageway, opening or pore whether made mechanically, by laser drilling, by pore formation either during the coating process or in situ during use or by rupture during use. In certain embodiments, the coating is present in an amount ranging from about 5 to 30 wt % (including, for example, 10 to 20 wt %) relative to the core weight.

One form of coating is a semipermeable polymeric membrane that has the port(s) formed therein either prior to or during use. Thickness of such a polymeric membrane may vary between about 20 and 800 µm (including, for example, between about 100 to 500 µm). The diameter of the delivery port (s) may generally range in size from 0.1 to 3000 µm or greater (including, for example, from about 50 to 3000 µm in diameter). Such port(s) may be formed post-coating by mechanical or laser drilling or may be formed in situ by rupture of the coatings; such rupture may be controlled by intentionally incorporating a relatively small weak portion into the coating. Delivery ports may also be formed in situ by erosion of a plug of water-soluble material or by rupture of a thinner portion of the coating over an indentation in the core. In addition, delivery ports may be formed during coating, as in the case of asymmetric membrane coatings of the type disclosed in U.S. Pat. No. 5,612,059 and U.S. Pat. No. 5,698,220. The delivery port may be formed in situ by rupture of the coating, for example, when a collection of beads that may be of essentially identical or of a variable agent are used. Drug is primarily released from such beads following rupture of the coating and, following rupture, such release may be gradual or relatively sudden. When the collection of beads has a variable agent, the agent may be chosen such that the beads rupture at various times following administration, resulting in the overall release of drug being sustained for a desired duration.

Coatings may be dense, microporous or asymmetric, having a denser region supported by a thick porous region such as those disclosed in U.S. Pat. No. 5,612,059 and U.S. Pat. No. 5,698,220. When the coating is dense the coating can be composed of a water-permeable material. When the coating is porous, it may be composed of either a water-permeable or a water-impermeable material. When the coating is composed of a porous water-impermeable material, water permeates through the pores of the coating as either a liquid or a vapor. Nonlimiting examples of osmotic devices that utilize dense coatings include U.S. Pat. No. 3,995,631 and U.S. Pat. No. 3,845,770. Such dense coatings are permeable to the external fluid such as water and may be composed of any of the materials mentioned in these patents as well as other water-permeable polymers known in the art.

The membranes may also be porous as disclosed, for example, in U.S. Pat. No. 5,654,005 and U.S. Pat. No. 5,458,887 or even be formed from water-resistant polymers. U.S. Pat. No. 5,120,548 describes another suitable process for forming coatings from a mixture of a water-insoluble polymer and a leachable water-soluble additive. The porous membranes may also be formed by the addition of pore-formers as disclosed in U.S. Pat. No. 4,612,008. In addition, vapor-permeable coatings may even be formed from extremely hydrophobic materials such as polyethylene or polyvinylidene difluorid that, when dense, are essentially water-impermeable, as long as such coatings are porous. Materials useful in forming the coating include but are not limited to various grades of acrylic, vinyls, ethers, polyamides, polyesters and cellulosic derivatives that are water-permeable and water-insoluble at physiologically relevant pHs, or are susceptible to being rendered water-insoluble by chemical alteration such as by crosslinking. Nonlimiting examples of suitable polymers (or crosslinked versions) useful in forming the coating include plasticized, unplasticized and reinforced cellulose acetate (CA), cellulose diacetate, cellulose triacetate, CA propionate, cellulose nitrate, cellulose acetate butyrate (CAB), CA ethyl carbamate, CAP, CA methyl carbamate, CA succinate, cellulose acetate trimellitate (CAT), CA dimethylaminoacetate, CA ethyl carbonate, CA chloroacetate, CA ethyl oxalate, CA methyl sulfonate, CA butyl sulfonate, CA p-toluene sulfonate, agar acetate, amylose triacetate, beta glucan acetate, beta glucan triacetate, acetaldehyde dimethyl acetate, triacetate of locust bean gum, hydroxiated ethylene-vinylacetate, EC, PEG, PPG, PEG/PPG copolymers, PVP, HEC, HPC, CMC, CMEC, HPMC, HPMCP, HPMCAS, HPMCAT, poly (acrylic) acids and esters and poly-(methacrylic) acids and esters and copolymers thereof, starch, dextran, dextrin, chitosan, collagen, gelatin, polyalkenes, polyethers, polysulfones, polyethersulfones, polystyrenes, polyvinyl halides, polyvinyl esters and ethers, natural waxes and synthetic waxes. In various embodiments, the coating agent comprises a cellulosic polymer, in particular cellulose ethers, cellulose esters and cellulose ester-ethers, i.e., cellulosic derivatives having a mixture of ester and ether substituents, the coating materials are made or derived from poly (acrylic) acids and esters, poly (methacrylic) acids and esters, and copolymers thereof, the coating agent comprises cellulose acetate, the coating comprises a cellulosic polymer and PEG, the coating comprises cellulose acetate and PEG.

Coating is conducted in conventional fashion, typically by dissolving or suspending the coating material in a solvent and then coating by dipping, spray coating or by pan-coating. In certain embodiments, the coating solution contains 5 to 15 wt % polymer. Typical solvents useful with the cellulosic polymers mentioned above include but are not limited to acetone, methyl acetate, ethyl acetate, isopropyl acetate, n-butyl acetate, methyl isobutyl ketone, methyl propyl ketone, ethylene glycol monoethyl ether, ethylene glycol monoethyl acetate, methylene dichloride, ethylene dichloride, propylene dichloride, nitroethane, nitropropane, tetrachloroethane, 1,4-dioxane, tetrahydrofuran, diglyme, water, and mixtures thereof. Pore-formers and non-solvents (such as water, glycerol and ethanol) or plasticizers (such as diethyl phthalate) may also be added in any amount as long as the polymer remains soluble at the spray temperature. Pore-formers and their use in fabricating coatings are described, for example, in U.S. Pat. No. 5,612,059. Coatings may also be hydrophobic microporous layers wherein the pores are substantially filled with a gas and are not wetted by the aqueous medium but are permeable to water vapor, as disclosed, for example, in U.S. Pat. No. 5,798,119. Such hydrophobic but water-vapor permeable coatings are typically composed of hydrophobic polymers such as polyalkenes, polyacrylic acid derivatives, polyethers, polysulfones, polyethersulfones, polystyrenes, polyvinyl halides, polyvinyl esters and ethers, natural waxes and synthetic waxes. Hydrophobic microporous coating materials include but are not limited to polystyrene, polysulfones, polyethersulfones, polyethylene, polypropylene, polyvinyl chloride, polyvinylidene fluoride and polytetrafluoroethylene. Such hydrophobic coatings can be made by known phase inversion methods using any of vapor-quench, liquid quench, thermal processes, leaching soluble material from the coating or by sintering coating particles. In thermal processes, a solution of polymer in a latent solvent is brought to liquid-liquid phase separation in a cooling step. When evaporation of the solvent is not prevented, the resulting membrane will typically be porous. Such coating processes may be conducted by the processes disclosed, for example, in U.S. Pat. No. 4,247,498, U.S. Pat. No. 4,490,431 and U.S. Pat. No. 4,744,906. Osmotic controlled-release devices may be prepared using procedures known in the pharmaceutical arts. See for example, Remington: The Science and Practice of Pharmacy, 20th Edition, 2000.

As further noted above, the agents described herein may be provided in the form of microparticulates, generally ranging in size from about 10 μm to about 2 mm (including, for example, from about 100 μm to 1 mm in diameter). Such multiparticulates may be packaged, for example, in a capsule such as a gelatin capsule or a capsule formed from an aqueous-soluble polymer such as HPMCAS, HPMC or starch; dosed as a suspension or slurry in a liquid; or they may be formed into a tablet, caplet, or pill by compression or other processes known in the art. Such multiparticulates may be made by any known process, such as wet- and dry-granulation processes, extrusion/spheronization, roller-compaction, melt-congealing, or by spray-coating seed cores. For example, in wet-and dry-granulation processes, the agent described herein and optional excipients may be granulated to form multiparticulates of the desired size. Other excipients, such as a binder (e.g., microcrystalline cellulose), may be blended with the agent to aid in processing and forming the multiparticulates. In the case of wet granulation, a binder such as microcrystalline cellulose may be included in the granulation fluid to aid in forming a suitable multiparticulate.

See, for example, Remington: The Science and Practice of Pharmacy, 20 Edition, 2000. In any case, the resulting particles may themselves constitute the therapeutic composition or they may be coated by various film-forming materials such as enteric polymers or water-swellable or water-soluble polymers, or they may be combined with other excipients or vehicles to aid in dosing to patients. Suitable pharmaceutical compositions in accordance with the disclosure will generally include an amount of the active compound(s) with an acceptable pharmaceutical diluent or excipient, such as a sterile aqueous solution, to give a range of final concentrations, depending on the intended use. The techniques of preparation are generally well known in the art, as exemplified by Remington's Pharmaceutical Sciences (18th Edition, Mack Publishing Company, 1995).

Kits

The agents described herein and combination therapy agents can be packaged as a kit that includes single or multiple doses of two or more agents, each packaged or formulated individually, or single or multiple doses of two or more agents packaged or formulated in combination. Thus, one or more agents can be present in first container, and the kit can optionally include one or more agents in a second container. The container or containers are placed within a package, and the package can optionally include administration or dosage instructions. A kit can include additional components such as syringes or other means for administering the agents as well as diluents or other means for formulation.

Thus, the kits can comprise: a) a pharmaceutical composition comprising a compound described herein and a pharmaceutically acceptable carrier, vehicle or diluent; and b) a container or packaging. The kits may optionally comprise instructions describing a method of using the pharmaceutical compositions in one or more of the methods described herein (e.g. disorders associated with fluid and sodium retention (such as diseases of the electrolyte-water/electrolyte transport system within the kidney, gut and urogenital system, heart failure (e.g. congestive heart failure including heart failure at any of stages I-IV according to New York Heart Association (NYHA) Functional Classification), hypertension, hypotension, salt dependent forms of high blood pressure, hepatic edema, liver cirrhosis, kidney disease, polycystic kidney disease) and gastrointestinal disorders (e.g. gastrointestinal motility disorders, chronic intestinal pseudo-obstruction, colonic pseudo-obstruction, Crohn's disease, duodenogastric reflux, dyspepsia, functional dyspepsia, non-ulcer dyspepsia, a functional gastrointestinal disorder, functional heartburn, gastroesophageal reflux disease (GERD), gastroparesis, irritable bowel syndrome, post-operative ileus, ulcerative colitis, chronic constipation, and disorders and conditions associated with constipation (e.g. constipation associated with use of opiate pain killers, post-surgical constipation, and constipation associated with neuropathic disorders as well as other conditions and disorders described herein)). The kit may optionally comprise a second pharmaceutical composition comprising one or more additional agents including but not limited to those including analgesic peptides and compounds, an agent used to treat heart failure (Diuretics (e.g. furesomide (Lasix), bumetanide (Bumex), ethacrynic acid (Edecrin), torsemide (Demadex), amiloride (Midamor), spironolactone (Aldactone), chorthiazide (Diuril), metolazone (Zaroxylyn)), Angiotension-Converting Enzyme (ACE) inhibitors (e.g. captopril (Capoten), enalopril (Vasotec), lisinopril (Prinivil, Zestril), ramipril (Altace)), Beta blockers (e.g. carvedilol (Coreg) and Inotropes (e.g. digoxin, dobutaimine, dopamine Milrinone)), a phosphodiesterase inhibitor, an agent used to treat gastrointestinal and other disorders (including those described herein), an agent used to treat constipation, an antidiarrheal agent, an insulin or related compound (including those described herein), an antihypertensive agent, an agent useful in the treatment of respiratory and other disorders, an anti-obesity agent, an antidiabetic agents, an agent that activates soluble guanylate cyclase and a pharmaceutically acceptable carrier, vehicle or diluent. The pharmaceutical composition comprising the compound described herein and the second pharmaceutical composition contained in the kit may be optionally combined in the same pharmaceutical composition.

A kit includes a container or packaging for containing the pharmaceutical compositions and may also include divided containers such as a divided bottle or a divided foil packet. The container can be, for example a paper or cardboard box, a glass or plastic bottle or jar, a re-sealable bag (for example, to hold a "refill" of tablets for placement into a different container), or a blister pack with individual doses for pressing out of the pack according to a therapeutic schedule. It is feasible that more than one container can be used together in a single package to market a single dosage form. For example, tablets may be contained in a bottle which is in turn contained within a box.

An example of a kit is a so-called blister pack. Blister packs are well known in the packaging industry and are being widely used for the packaging of pharmaceutical unit dosage forms (tablets, capsules, and the like). Blister packs generally consist of a sheet of relatively stiff material covered with a foil of a preferably transparent plastic material. During the packaging process, recesses are formed in the plastic foil. The recesses have the size and shape of individual tablets or capsules to be packed or may have the size and shape to accommodate multiple tablets and/or capsules to be packed. Next, the tablets or capsules are placed in the recesses accordingly and the sheet of relatively stiff material is sealed against the plastic foil at the face of the foil which is opposite from the direction in which the recesses were formed. As a result, the tablets or capsules are individually sealed or collectively sealed, as desired, in the recesses between the plastic foil and the sheet. Preferably the strength of the sheet is such that the tablets or capsules can be removed from the blister pack by manually applying pressure on the recesses whereby an opening is formed in the sheet at the place of the recess. The tablet or capsule can then be removed via said opening.

It maybe desirable to provide a written memory aid containing information and/or instructions for the physician, pharmacist or subject regarding when the medication is to be taken. A "daily dose" can be a single tablet or capsule or several tablets or capsules to be taken on a given day. When the kit contains separate compositions, a daily dose of one or more compositions of the kit can consist of one tablet or capsule while a daily dose of another one or more compositions of the kit can consist of several tablets or capsules. A kit can take the form of a dispenser designed to dispense the daily doses one at a time in the order of their intended use. The dispenser can be equipped with a memory-aid, so as to further facilitate compliance with the regimen. An example of such a memory-aid is a mechanical counter which indicates the number of daily doses that have been dispensed. Another example of such a memory-aid is a battery-powered microchip memory coupled with a liquid crystal readout, or audible reminder signal which, for example, reads out the date that the last daily dose has been taken and/or reminds one when the next dose is to be taken.

Methods to increase chemical and/or physical stability of the agents the described herein are found in U.S. Pat. No. 6,541,606, U.S. Pat. No. 6,068,850, U.S. Pat. No. 6,124,261, U.S. Pat. No. 5,904,935, and WO 00/15224, U.S. 20030069182 (via the addition of nicotinamide), U.S. 20030175230A1, U.S. 20030175230A1, U.S. 20030175239A1, U.S. 20020045582, U.S. 20010031726, WO 02/26248, WO 03/014304, WO 98/00152A1, WO 98/00157A1, WO 90/12029, WO 00/04880, and WO 91/04743, WO 97/04796 and the references cited therein.

Methods to increase bioavailability of the agents described herein are found in U.S. Pat. No. 6,008,187, U.S. Pat. No. 5,424,289, U.S. 20030198619, WO 90/01329, WO 01/49268, WO 00/32172, and WO 02/064166. Glycyrrhizinate can also be used as an absorption enhancer (see, e.g., EP397447). WO 03/004062 discusses *Ulex europaeus* I (UEA1) and UEAI mimetics which may be used to target the agents described herein to the GI tract. The bioavailability of the agents described herein can also be increased by addition of oral bioavailability-enhancing agents such as those described in U.S. Pat. No. 6,818,615 including but not limited to: cyclosporins (including cyclosporins A through Z as defined in Table 1 of U.S. Pat. No. 6,818,615), for example, cyclosporin A (cyclosporin), cyclosporin F, cyclosporin D, dihydro cyclosporin A, dihydro cyclosporin C, acetyl cyclosporin A, PSC-833, (Me-Ile-4)-cyclosporin (SDZ-NIM 811) (both from Sandoz Pharmaceutical Corp.), and related oligopeptides produced by species in the genus *Topycladium*); antifungals including but not limited to ketoconazole; cardiovascular drug including but not limited to MS-209 (BASF), amiodarone, nifedipine, reserpine, quinidine, nicardipine, ethacrynic acid, propafenone, reserpine, amiloride; anti-migraine natural products including but not limited to ergot alkaloids; antibiotics including but not limited to cefoperazone, tetracycline, chloroquine, fosfomycin; antiparasitics including but not limited to ivermectin; multi-drug resistance reversers including but not limited to VX-710 and VX-853 (Vertex Pharmaceutical Incorporated); tyrosine kinase inhibitors including but not limited to genistein and related isoflavonoids, quercetin; protein kinase C inhibitors including but not limited to calphostin; apoptosis inducers including but not limited to ceramides; and agents active against endorphin receptors including but not limited to morphine, morphine congeners, other opioids and opioid antagonists including (but not limited to) naloxone, naltrexone and nalmefene).

The agents described herein can be fused to a modified version of the blood serum protein transferrin. U.S. 20030221201, U.S. 20040023334, U.S. 20030226155, WO 04/020454, and WO 04/019872 discuss the manufacture and use of transferrin fusion proteins. Transferrin fusion proteins may improve circulatory half life and efficacy, decrease undesirable side effects and allow reduced dosage.

The peptides and agonists described herein can be recombinantly expressed in bacteria. Bacteria expressing the peptide or agonists can be administered orally, rectally, mucosally or in via some other mode of administration including but not limited to those described herein. Bacterial hosts suitable for such administration include but are not limited to certain *Lactobacteria* (e.g. *Lactococcus lactis*, *Lactobacillus plantarum*, *Lact. rhamnosus* and *Lact. paracasei* ssp. *Paracasie* and other species found in normal human flora (Ahrne et al. Journal of Applied Microbiology 1998 85:88)), certain *Streptococcus* sp. (e.g. *S. gordonii*), and certain *B. subtilis* strains (including pSM539 described in Porzio et al. BMC Biotechnology 2004 4:27). The peptides and agonists described herein can be administered using the *Heliobacter* based preparation methods described in WO06/015445.

Dosage

The dose range for adult humans is generally from 0.005 mg to 10 g/day orally. Tablets or other forms of presentation provided in discrete units may conveniently contain an amount of compound described herein which is effective at such dosage or as a multiple of the same, for instance, units containing 5 mg to 500 mg, usually around 10 mg to 200 mg. The precise amount of compound administered to a patient will be the responsibility of the attendant physician. However, the dose employed will depend on a number of factors, including the age and sex of the patient, the precise disorder being treated, and its severity.

A dosage unit (e.g. an oral dosage unit) can include from, for example, 1 to 30 µg, 1 to 40 µg, 1 to 50 µg, 1 to 100 µg, 1 to 200 µg, 1 to 300 µg, 1 to 400 µg, 1 to 500 µg, 1 to 600 µg, 1 to 700 µg, 1 to 800 µg, 1 to 900 µg, 1 to 1000 µg, 10 to 30 µg, 10 to 40 µg, 10 to 50 µg, 10 to 100 µg, 10 to 200 µg, 10 to 300 µg, 10 to 400 µg, 10 to 500 µg, 10 to 600 µg, 10 to 700 µg, 10 to 800 µg, 10 to 900 µg, 10 to 1000 µg, 100 to 200 µg, 100 to 300 µg, 100 to 400 µg, 100 to 500 µg, 100 to 600 µg, 100 to 700 µg, 100 to 800 µg, 100 to 900 µg, 100 to 1000 µg, 100 to 1250 µg, 100 to 1500 µg, 100 to 1750 µg, 100 to 2000 µg, 100 to 2250 µg, 100 to 2500 µg, 100 to 2750 µg, 100 to 3000 µg, 200 to 300 µg, 200 to 400 µg, 200 to 500 µg, 200 to 600 µg, 200 to 700 µg, 200 to 800 µg, 200 to 900 µg, 200 to 1000 µg, 200 to 1250 µg, 200 to 1500 µg, 200 to 1750 µg, 200 to 2000 µg, 200 to 2250 µg, 200 to 2500 µg, 200 to 2750 µg, 200 to 3000 µg, 300 to 400 µg, 300 to 500 µg, 300 to 600 µg, 300 to 700 µg, 300 to 800 µg, 300 to 900 µg, 300 to 1000 µg, 300 to 1250 µg, 300 to 1500 µg, 300 to 1750 µg, 300 to 2000 µg, 300 to 2250 µg, 300 to 2500 µg, 300 to 2750 µg, 300 to 3000 µg, 400 to 500 µg, 400 to 600 µg, 400 to 700 µg, 400 to 800 µg, 400 to 900 µg, 400 to 1000 µg, 400 to 1250n, 400 to 1500 µg, 400 to 1750 µg, 400 to 2000 µg, 400 to 2250 µg, 400 to 2500 µg, 400 to 2750 µg, 400 to 3000 µg, 500 to 600 µg, 500 to 700 µg, 500 to 800 µg, 500 to 900 µg, 500 to 1000 µg, 500 to 1250 µg, 500 to 1500 µg, 500 to 1750 µg, 500 to 2000 µg, 500 to 2250 µg, 500 to 2500 µg, 500 to 2750 µg, 500 to 3000 µg, 600 to 700 µg, 600 to 800 µg, 600 to 900 µg, 600 to 1000 µg, 600 to 1250 µg, 600 to 1500 µg, 600 to 1750 µg, 600 to 2000 µg, 600 to 2250 µg, 600 to 2500 µg, 600 to 2750 µg, 600 to 3000 µg, 700 to 800 µg, 700 to 900 µg, 700 to 1000 µg, 700 to 1250 µg, 700 to 1500 µg, 700 to 1750 µg, 700 to 2000 µg, 700 to 2250 µg, 700 to 2500 µg, 700 to 2750 µg, 700 to 3000 µg, 800 to 900 µg, 800 to 1000 µg, 800 to 1250 µg, 800 to 1500 µg, 800 to 1750 µg, 800 to 2000 µg, 800 to 2250 µg, 800 to 2500 µg, 800 to 2750 µg, 800 to 3000 µg, 900 to 1000 µg, 900 to 1250 µg, 900 to 1500 µg, 900 to 1750 µg, 900 to 2000 µg, 900 to 2250 µg, 900 to 2500 µg, 900 to 2750 µg, 900 to 3000 µg, 1000 to 1250 µg, 1000 to 1500 µg, 1000 to 1750 µg, 1000 to 2000 µg, 1000 to 2250 µg, 1000 to 2500 µg, 1000 to 2750 µg, 1000 to 3000 µg, 2 to 500 µg, 50 to 500 µg, 3 to 100 µg, 5 to 20 µg, 5 to 100 µg, 10 µg, 20 µg, 30 µg, 40 µg, 50 µg, 60 µg, 70 µg, 75 µg, 80 µg, 90 µg, 100 µg, 150 µg, 200 µg, 250 µg, 300 µg, 350 µg, 400 µg, 450 µg, 500 µg, 550 µg, 600 µg, 650 µg, 700 µg, 750 µg, 800 µg, 850 µg, 900 µg, 950 µg, 1000 µg, 1050 µg, 1100 µg, 1150 µg, 1200 µg, 1250 µg, 1300 µg, 1350 µg, 1400 µg, 1450 µg, 1500 µg, 1550 µg, 1600 µg, 1650 µg, 1700 µg, 1750 µg, 1800 µg, 1850 µg, 1900 µg, 1950 µg, 2000 µg, 2050 µg, 2100 µg, 2150 µg, 2200 µg, 2250 µg, 2300 µg, 2350 µg, 2400 µg, 2450 µg, 2500 µg, 2550 µg, 2600 µg, 2650 µg, 2700 µg, 2750 µg, 2800 µg, 2850 µg, 2900 µg, 2950 µg, 3000 µg, 3250 µg, 3500 µg, 3750 µg, 4000 µg, 4250 µg, 4500 µg, 4750 µg, 5000 µg of a peptide or agonist described herein. In various embodiments, the dosage unit is administered with food at anytime of the day, without food at anytime of the day, with food after an overnight fast (e.g. with breakfast), at bedtime after a low fat snack. In various embodiments, the dosage unit is administered once a day, twice a day, three times a day, four times a day, five times a day, six times a day. The dosage unit can optionally comprise other agents.

A dosage unit (e.g. an oral dosage unit) can include, for example, from 1 to 30 µg, 1 to 40 µg, 1 to 50 µg, 1 to 100 µg, 1 to 200 µg, 1 to 300 µg, 1 to 400 µg, 1 to 500 µg, 1 to 600 µg, 1 to 700 µg, 1 to 800 µg, 1 to 900 µg, 1 to 1000 µg, 10 to 30 µg, 10 to 40 µg, 10 to 50 µg, 10 to 100 µg, 10 to 200 µg, 10 to 300 µg, 10 to 400 µg, 10 to 500 µg, 10 to 600 µg, 10 to 700 µg, 10 to 800 µg, 10 to 900 µg, 10 to 1000 µg, 100 to 200 µg, 100 to 300 µg, 100 to 400 µg, 100 to 500 µg, 100 to 600 µg, 100 to 700 µg, 100 to 800 µg, 100 to 900 µg, 100 to 1000 µg, 100 to 1250 µg, 100 to 1500 µg, 100 to 1750 µg, 100 to 2000 µg, 100 to 2250 µg, 100 to 2500 µg, 100 to 2750 µg, 100 to 3000 µg, 200 to 300 µg, 200 to 400 µg, 200 to 500 µg, 200 to 600 µg, 200 to 700 µg, 200 to 800 µg, 200 to 900 µg, 200 to 1000 µg, 200 to 1250 µg, 200 to 1500 µg, 200 to 1750 µg, 200 to 2000 µg, 200 to 2250 µg, 200 to 2500 µg, 200 to 2750 µg, 200 to 3000 µg, 300 to 400 µg, 300 to 500 µg, 300 to 600 µg, 300 to 700 µg, 300 to 800 µg, 300 to 900 µg, 300 to 1000 µg, 300 to 1250 µg, 300 to 1500 µg, 300 to 1750 µg, 300 to 2000 µg, 300 to 2250 µg, 300 to 2500 µg, 300 to 2750 µg, 300 to 3000 µg, 400 to 500 µg, 400 to 600 µg, 400 to 700 µg, 400 to 800 µg, 400 to 900 µg, 400 to 1000 µg, 400 to 1250 µg, 400 to 1500 µg, 400 to 1750 µg, 400 to 2000 µg, 400 to 2250 µg, 400 to 2500 µg, 400 to 2750 µg, 400 to 3000 µg, 500 to 600 µg, 500 to 700 µg, 500 to 800 µg, 500 to 900 µg, 500 to 1000 µg, 500 to 1250 µg, 500 to 1500 µg, 500 to 1750 µg, 500 to 2000 µg, 500 to 2250 µg, 500 to 2500 µg, 500 to 2750 µg, 500 to 3000 µg, 600 to 700 µg, 600 to 800 µg, 600 to 900 µg, 600 to 1000 µg, 600 to 1250 µg, 600 to 1500 µg, 600 to 1750 µg, 600 to 2000 µg, 600 to 2250 µg, 600 to 2500 µg, 600 to 2750 µg, 600 to 3000 µg, 700 to 800 µg, 700 to 900 µg, 700 to 1000 µg, 700 to 1250 µg, 700 to 1500 µg, 700 to 1750 µg, 700 to 2000 µg, 700 to 2250 µg, 700 to 2500 µg, 700 to 2750 µg, 700 to 3000 µg, 800 to 900 µg, 800 to 1000 µg, 800 to 1250 µg, 800 to 1500 µg, 800 to 1750 µg, 800 to 2000 µg, 800 to 2250 µg, 800 to 2500 µg, 800 to 2750 µg, 800 to 3000 µg, 900 to 1000 µg, 900 to 1250 µg, 900 to 1500 µg, 900 to 1750 µg, 900 to 2000 µg, 900 to 2250 µg, 900 to 2500 µg, 900 to 2750 µg, 900 to 3000 µg, 1000 to 1250 µg, 1000 to 1500 µg, 1000 to 1750 µg, 1000 to 2000 µg, 1000 to 2250 µg, 1000 to 2500 µg, 1000 to 2750 µg, 1000 to 3000 µg, 2 to 500 µg, 50 to 500 µg, 3 to 100 µg, 5 to 20 µg, 5 to 100 µg, 10 µg, 20 µg, 30 µg, 40 µg, 50 µg, 60 µg, 70 µg, 75 µg, 80 µg, 90 µg, 100 µg, 150 µg, 200 µg, 250 µg, 300 µg, 350 µg, 400 µg, 450 µg, 500 µg, 550 µg, 600 µg, 650 µg, 700 µg, 750 µg, 800 µg, 850 µg, 900 µg, 950 µg, 1000 µg, 1050 µg, 1100 µg, 1150 µg, 1200 µg, 1250 µg, 1300 µg, 1350 µg, 1400 µg, 1450 µg, 1500 µg, 1550 µg, 1600 µg, 1650 µg, 1700 µg, 1750 µg, 1800 µg, 1850 µg, 1900 µg, 1950 µg, 2000 µg, 2050 µg, 2100 µg, 2150 µg, 2200 µg, 2250 µg, 2300 µg, 2350 µg, 2400 µg, 2450 µg, 2500 µg, 2550 µg, 2600 µg, 2650 µg, 2700 µg, 2750 µg, 2800 µg, 2850 µg, 2900 µg, 2950 µg, 3000 µg, 3250 µg, 3500 µg, 3750 µg, 4000 µg, 4250 µg, 4500 µg, 4750 µg, 5000 µg of a peptide or agonist described herein and from 10 mg to 600 mg (e.g. 10 mg, 20 mg, 30 mg, 40 mg, 50 mg, 60 mg, 70 mg, 80 mg, 90 mg, 100 mg, 120 mg, 140 mg, 160 mg, 180 mg, 200 mg, 220 mg, 240 mg, 260 mg, 280 mg, 300 mg, 320 mg, 340 mg, 360 mg, 380 mg, 400 mg, 420 mg, 440 mg, 460 mg, 480 mg, 500 mg, 520 mg, 540 mg, 560 mg, 580 mg, 600 mg) of furosemide (Lasix).

A dosage unit (e.g. an oral, intravenous or intramuscular dosage unit) can include, for example, from 1 to 30 µg, 1 to 40 µg, 1 to 50 µg, 1 to 100 µg, 1 to 200 µg, 1 to 300 µg, 1 to 400 µg, 1 to 500 µg, 1 to 600 µg, 1 to 700 µg, 1 to 800 µg, 1 to 900 µg, 1 to 1000 µg, 10 to 30 µg, 10 to 40 µg, 10 to 50 µg, 10 to 100 µg, 10 to 200 µg, 10 to 300 µg, 10 to 400 µg, 10 to 500 µg, 10 to 600 µg, 10 to 700 µg, 10 to 800 µg, 10 to 900 µg, 10 to 1000 µg, 100 to 200 µg, 100 to 300 µg, 100 to 400 µg, 100 to 500 µg, 100 to 600 µg, 100 to 700 µg, 100 to 800 µg, 100 to 900m, 100 to 1000 µg, 100 to 1250 µg, 100 to 1500 µg, 100 to 1750 µg, 100 to 2000 µg, 100 to 2250 µg, 100 to 2500 µg, 100 to 2750 µg, 100 to 3000 µg, 200 to 300 µg, 200 to 400 µg, 200 to 500 µg, 200 to 600 µg, 200 to 700 µg, 200 to 800 µg, 200 to 900 µg, 200 to 1000 µg, 200 to 1250 µg, 200 to 1500 µg, 200 to 1750 µg, 200 to 2000 µg, 200 to 2250 µg, 200 to 2500 µg, 200 to 2750 µg, 200 to 3000 µg, 300 to 400 µg, 300 to 500 µg, 300 to 600 µg, 300 to 700 µg, 300 to 800 µg, 300 to 900 µg, 300 to 1000 µg, 300 to 1250 µg, 300 to 1500 µg, 300 to 1750 µg, 300 to 2000 µg, 300 to 2250 µg, 300 to 2500 µg, 300 to 2750 µg, 300 to 3000 µg, 400 to 500 µg, 400 to 600 µg, 400 to 700 µg, 400 to 800 µg, 400 to 900 µg, 400 to 1000 µg, 400 to 1250 µg, 400 to 1500 µg, 400 to 1750 µg, 400 to 2000 µg, 400 to 2250 µg, 400 to 2500 µg, 400 to 2750 µg, 400 to 3000 µg, 500 to 600 µg, 500 to 700 µg, 500 to 800 µg, 500 to 900 µg, 500 to 1000 µg, 500 to 1250 µg, 500 to 1500 µg, 500 to 1750 µg, 500 to 2000 µg, 500 to 2250 µg, 500 to 2500 µg, 500 to 2750 µg, 500 to 3000 µg, 600 to 700 µg, 600 to 800 µg, 600 to 900 µg, 600 to 1000 µg, 600 to 1250 µg, 600 to 1500 µg, 600 to 1750 µg, 600 to 2000 µg, 600 to 2250 µg, 600 to 2500 µg, 600 to 2750 µg, 600 to 3000 µg, 700 to 800 µg, 700 to 900 µg, 700 to 1000 µg, 700 to 1250 µg, 700 to 1500 µg, 700 to 1750 µg, 700 to 2000 µg, 700 to 2250 µg, 700 to 2500 µg, 700 to 2750 µg, 700 to 3000 µg, 800 to 900 µg, 800 to 1000 µg, 800 to 1250 µg, 800 to 1500 µg, 800 to 1750 µg, 800 to 2000 µg, 800 to 2250 µg, 800 to 2500 µg, 800 to 2750 µg, 800 to 3000 µg, 900 to 1000 µg, 900 to 1250 µg, 900 to 1500 µg, 900 to 1750 µg, 900 to 2000 µg, 900 to 2250 µg, 900 to 2500 µg, 900 to 2750 µg, 900 to 3000 µg, 1000 to 1250 µg, 1000 to 1500 µg, 1000 to 1750 µg, 1000 to 2000 µg, 1000 to 2250 µg, 1000 to 2500 µg, 1000 to 2750 µg, 1000 to 3000 µg, 2 to 500 µg, 50 to 500 µg, 3 to 100 µg, 5 to 20 µg, 5 to 100 µg, 10 µg, 20 µg, 30 µg, 40 µg, 50 µg, 60 µg, 70 µg, 75 µg, 80 µg, 90 µg, 100 µg, 150 µg, 200 µg, 250 µg, 300 µg, 350 µg, 400 µg, 450 µg, 500 µg, 550 µg, 600 µg, 650 µg, 700 µg, 750 µg, 800 µg, 850 µg, 900 µg, 950 µg, 1000 µg, 1050 µg, 1100 µg, 1150 µg, 1200 µg, 1250 µg, 1300 µg, 1350 µg, 1400 µg, 1450 µg, 1500 µg, 1550 µg, 1600 µg, 1650 µg, 1700 µg, 1750 µg, 1800 µg, 1850 µg, 1900 µg, 1950 µg, 2000 µg, 2050 µg, 2100 µg, 2150 µg, 2200 µg, 2250 µg, 2300 µg, 2350 µg, 2400 µg, 2450 µg, 2500 µg, 2550 µg, 2600 µg, 2650 µg, 2700 µg, 2750 µg, 2800 µg, 2850 µg, 2900 µg, 2950 µg, 3000 µg, 3250 µg, 3500 µg, 3750 µg, 4000 µg, 4250 µg, 4500 µg, 4750 µg, 5000 µg of a peptide or agonist described herein and from 0.2 mg to 10 mg (e.g. 0.2 mg, 0.4 mg, 0.5 mg, 0.75 mg, 1 mg, 1.5 mg, 2 mg, 2.5 mg, 3 mg, 3.5 mg, 4 mg, 4.5 mg, 5 mg, 5.5 mg, 6 mg, 6.5 mg, 7 mg, 7.5 mg, 8 mg, 8.5 mg, 9 mg, 9.5 mg, 10 mg) of bumetanide (Bumex®).

The precise amount of each of the two or more active ingredients in a dosage unit will depend on the desired dosage of each component. Thus, it can be useful to create a dosage unit that will, when administered according to a particular dosage schedule (e.g., a dosage schedule specifying a certain number of units and a particular timing for administration), deliver the same dosage of each component as would be administered if the patient was being treated with only a single component. In other circumstances, it might be desirable to create a dosage unit that will deliver a dosage of one or more components that is less than that which would be administered if the patient was being treated only with a single component. Finally, it might be desirable to create a dosage unit that will deliver a dosage of one or more components that is greater than that which would be administered if the patient was being treated only with a single component. The pharmaceutical composition can include additional ingredients including but not limited to the excipients described herein. In certain embodiments, one or more therapeutic agents of the dosage unit may exist in an extended or control release formulation and additional therapeutic agents may not exist in extended release formulation. For example, a peptide or agonist described herein may exist in a controlled release formulation or extended release formulation in the same dosage unit with another agent that may or may not be in either a controlled release or extended release formulation. Thus, in certain embodiments, it may be desirable to provide for the immediate release of one or more of the agents described herein, and the controlled release of one or more other agents.

In certain embodiments the dosage unit and daily dose are equivalent. In certain embodiments the dosage unit and the daily dose are not equivalent. In various embodiments, the dosage unit is administered twenty minutes prior to food consumption, twenty minutes after food consumption, with food at anytime of the day, without food at anytime of the day, with food after an overnight fast (e.g. with breakfast), at bedtime after a low fat snack. In various embodiments, the dosage unit is administered once a day, twice a day, three times a day, four times a day, five times a day, six times a day.

When two or more active ingredients are combined in single dosage form, chemical interactions between the active ingredients may occur. For example, acidic and basic active ingredients can react with each other and acidic active ingredients can facilitate the degradation of acid labile substances. Thus, in certain dosage forms, acidic and basic substances can be physically separated as two distinct or isolated layers in a compressed tablet, or in the core and shell of a press-coated tablet. Additional agents that are compatible with acidic as well as basic substances, have the flexibility of being placed in either layer. In certain multiple layer compositions at least one active ingredient can be enteric-coated. In certain embodiments thereof at least one active ingredient can be presented in a controlled release form. In certain embodiments where a combination of three or more active substances are used, they can be presented as physically isolated segments of a compressed multilayer tablet, which can be optionally film coated.

The therapeutic combinations described herein can be formulated as a tablet or capsule comprising a plurality of beads, granules, or pellets. All active ingredients including the vitamins of the combination are formulated into granules or beads or pellets that are further coated with a protective coat, an enteric coat, or a film coat to avoid the possible chemical interactions. Granulation and coating of granules or beads is done using techniques well known to a person skilled in the art. At least one active ingredient can present in a controlled release form. Finally these coated granules or beads are filled into hard gelatin capsules or compressed to form tablets.

The therapeutic combinations described herein can be formulated as a capsule comprising microtablets or minitablets of all active ingredients. Microtablets of the individual agents can be prepared using well known pharmaceutical procedures of tablet making like direct compression, dry granulation or wet granulation. Individual microtablets can be filled into hard gelatin capsules. A final dosage form may comprise one or more microtablets of each individual component. The microtablets may be film coated or enteric coated.

The therapeutic combinations described herein can be formulated as a capsule comprising one or more microtablets and powder, or one or more microtablets and granules or beads. In order to avoid interactions between drugs, some active ingredients of a said combination can be formulated as microtablets and the others filled into capsules as a powder, granules, or beads. The microtablets may be film coated or enteric coated. At least one active ingredient can be presented in controlled release form.

The therapeutic combinations described herein can be formulated wherein the active ingredients are distributed in the inner and outer phase of tablets. In an attempt to divide chemically incompatible components of proposed combination, few interacting components are converted in granules or beads using well known pharmaceutical procedures in prior art. The prepared granules or beads (inner phase) are then mixed with outer phase comprising the remaining active ingredients and at least one pharmaceutically acceptable excipient. The mixture thus comprising inner and outer phase is compressed into tablets or molded into tablets. The granules or beads can be controlled release or immediate release beads or granules, and can further be coated using an enteric polymer in an aqueous or non-aqueous system, using methods and materials that are known in the art.

The therapeutic combinations described herein can be formulated as single dosage unit comprising suitable buffering agent. All powdered ingredients of said combination are mixed and a suitable quantity of one or more buffering agents is added to the blend to minimize possible interactions.

The agents described herein, alone or in combination, can be combined with any pharmaceutically acceptable carrier or medium. Thus, they can be combined with materials that do not produce an adverse, allergic or otherwise unwanted reaction when administered to a patient. The carriers or mediums used can include solvents, dispersants, coatings, absorption promoting agents, controlled release agents, and one or more inert excipients (which include starches, polyols, granulating agents, microcrystalline cellulose, diluents, lubricants, binders, disintegrating agents, and the like), etc. If desired, tablet dosages of the disclosed compositions may be coated by standard aqueous or nonaqueous techniques.

Treatment of the Side-Effects of Opioid Administration

GGC receptor agonists, e.g., GCC receptor agonist peptides described herein, may useful in the treatment of one or more side effects of opioid administration, e.g., opioid induced constipation, nausea and/or vomiting. In the case of constipation, the GCC receptor agonist peptide can be administered at a dosage to induce laxation within a desired time (e.g., within 15 minutes, 30 minutes, 1 hour, 2 hours, 3 hours, 4 hours, 5 hours, 6 hours, 7 hours, 8 hours, 9 hours, 10 hours, 12 hours, 18 hours or 24 hours).

The GCC receptor agonist peptide can be administered to maintain regular bowel movements in a patient who is a chronic opioid user (e.g., a terminally-ill patient). The administration can be via any convenient route (e.g., sublingual, parenteral, intravenous, subcutaneous).

Thus, the peptides described herein can be administered to a patient that is taking one or more of the following opioids: Acetorphine, Acetyldihydrocodeine, Acetylmorphone, Alfentanil, Allylprodine, Anileridine, Bemidone, Benzylmorphine, Bezitramide, Buprenorphine, Butorphanol, Carfentanil/Carfentanyl, Clonitazene, Codeine, Codeine-N-Oxide, Codeinone, Cyclazocine, Cyclorphan, Desomorphine, Dextromoramide, Dextropropoxyphene, Dezocine, Diacetyldihydromorphine, Diamorphine/Diacetylmorphine (Heroin), Diethylthiambutene, Difenoxin, Dihydrocodeine, Dihydrocodeinone Enol Acetate, Dihydroetorphine, Dihydroisocodeine, Dihydromorphine, Dimethylthiambutene, Diphenoxylate, Dipropanoylmorphine, Drobetabol, Ethylketocyclazocine, Ethylmorphine, Etonitazene, Etorphine, Fentanyl, Hydrocodone, Hydromorphone, Isomethadone, Ketobemidone, Laudanum, Lefetamine, Levallorphan, Levo-Alphacetylmethadol (LAAM), Levomethorphan, Levorphanol, Loperamide, Meptazinol, Metazocine, Methadone, Monoacetylmorphine, Morphine, Morphine-6-Glucuronide, Morphine-N-Oxide, Morphinone, MPPP (1-Methyl 4-Phenyl 4-Propionoxypiperidine), Myorphine, Nalbuphine/Nalbufine, Nicocodeine, Nicodicodeine, Nicomorphine, Norcodeine, Ohmefentanyl, Oxycodone, Oxymorphone, Pentazocine, PEPAP (1-Phenethyl-4-Phenyl-4-Piperidinol Acetate (Ester)), Pethidine (Meperidine), Phenadoxone, Phenazocine, Phenoperidine, Pholcodeine, Piminodine, Piritramide, Prodine, Propiram, Propoxyphene, Racemethorphan, Remifentanil, Sufentanil, Thebaine, Thiofentanil/Thiofentanyl, Tilidine, and Tramadol. The peptide can be co-administered with or co-formulated with any of the preceeding peptides.

Where the GCC receptor agonist is co-formulated with an opioid the composition may further include one or more other active ingredients that may be conventionally employed in analgesic and/or cough-cold-antitussive combination products. Such conventional ingredients include, for example, aspirin, acetaminophen, phenylpropanolamine, phenylephrine, chlorpheniramine, caffeine, and/or guaifenesin. Typical or conventional ingredients that may be included in the opioid component are described, for example, in the Physicians' Desk Reference, 1999, the disclosures of which are hereby incorporated herein by reference, in their entirety.

In addition, the composition may further include one or more compounds that may be designed to enhance the analgesic potency of the opioid and/or to reduce analgesic tolerance development. Such compounds include, for example, dextromethorphan or other NMDA antagonists (Mao, M. J. et al., Pain 1996, 67, 361), L-364,718 and other CCK antagonists (Dourish, C. T. et al., Eur J Pharmacol 1988, 147, 469), NOS inhibitors (Bhargava, H. N. et al., Neuropeptides 1996, 30, 219), PKC inhibitors (Bilsky, E. J. et al., J Pharmacol Exp Ther 1996, 277, 484), and dynorphin antagonists or antisera (Nichols, M. L. et al., Pain 1997, 69, 317). The disclosures of each of the foregoing documents are hereby incorporated herein by reference, in their entireties.

The combination products, such as pharmaceutical compositions comprising opioids in combination with a GCC agonist may be in any dosage form, such as those described herein, and can also be administered in various ways, as described herein. In a preferred embodiment, the combination products of the disclosure are formulated together, in a single dosage form (that is, combined together in one capsule, tablet, powder, or liquid, etc.). When the combination products are not formulated together in a single dosage form, the opioid compounds and the GCC agonists may be administered at the same time (that is, together), or in any order. When not administered at the same time, preferably the administration of an opioid and a GCC agonist occurs less than about one hour apart, less than about 30 minutes apart, less than about 15 minutes apart, and less than about 5 minutes apart. Administration of the combination of an opioid and a GCC agonist can be, for example, oral, although other routes of administration, as described above, are contemplated to be within the scope of the present disclosure. Although it is the opioids and GCC agonists may both be administered in the same fashion (that is, for example, both orally), if desired, they may each be administered in different fashions (that is, for example, one component of the combination product may be administered orally, and another component may be administered intravenously). The dosage of the combination products of the disclosure may vary depending upon various factors such as the pharmacodynamic characteristics of the particular agent and its mode and route of administration, the age, health and weight of the recipient, the nature and extent of the symptoms, the kind of concurrent treatment, the frequency of treatment, and the effect desired.

Although the proper dosage of the combination products of this disclosure will be readily ascertainable by one skilled in the art, by way of general guidance, where an opioid compounds is combined with a GCC agonist, for example, typically a daily dosage may range from about 0.01 to about 100 milligrams, 0.1 to about 10 milligrams of the opioid, 15 to about 200 milligrams, 1, 2, 3, 4, 5, 6, 7, 8, 9, 10 milligrams of opioid per kilogram of patient body weight. The opioid-GCC agonist combination product can include, for example, from 1 to 30 µg, 1 to 40 µg, 1 to 50 µg, 1 to 100 µg, 1 to 200 µg, 1 to 300 µg, 1 to 400 µg, 1 to 500 µg, 1 to 600 µg, 1 to 700 µg, 1 to 800 µg, 1 to 900 µg, 1 to 1000 µg, 10 to 30 µg, 10 to 40 µg, 10 to 50 µg, 10 to 100 µg, 10 to 200 µg, 10 to 300 µg, 10 to 400 µg, 10 to 500 µg, 10 to 600 µg, 10 to 700 µg, 10 to 800 µg, 10 to 900 µg, 10 to 1000 µg, 100 to 200 µg, 100 to 300 µg, 100 to 400 µg, 100 to 500 µg, 100 to 600 µg, 100 to 700 µg, 100 to 800 µg, 100 to 900 µg, 100 to 1000 µg, 100 to 1250 µg, 100 to 1500 µg, 100 to 1750 µg, 100 to 2000 µg, 100 to 2250 µg, 100 to 2500 µg, 100 to 2750 µg, 100 to 3000 µg, 200 to 300 µg, 200 to 400 µg, 200 to 500 µg, 200 to 600 µg, 200 to 700 µg, 200 to 800 µg, 200 to 900 µg, 200 to 1000 µg, 200 to 1250 µg, 200 to 1500 µg, 200 to 1750 µg, 200 to 2000 µg, 200 to 2250 µg, 200 to 2500 µg, 200 to 2750 µg, 200 to 3000 µg, 300 to 400 µg, 300 to 500 µg, 300 to 600 µg, 300 to 700 µg, 300 to 800 µg, 300 to 900 µg, 300 to 1000 µg, 300 to 1250 µg, 300 to 1500 µg, 300 to 1750 µg, 300 to 2000 µg, 300 to 2250 µg, 300 to 2500 µg, 300 to 2750 µg, 300 to 3000 µg, 400 to 500 µg, 400 to 600 µg, 400 to 700 µg, 400 to 800 µg, 400 to 900 µg, 400 to 1000 µg, 400 to 1250 µg, 400 to 1500 µg, 400 to 1750 µg, 400 to 2000 µg, 400 to 2250 µg, 400 to 2500 µg, 400 to 2750 µg, 400 to 3000 µg, 500 to 600 µg, 500 to 700 µg, 500 to 800 µg, 500 to 900 µg, 500 to 1000 µg, 500 to 1250 µg, 500 to 1500 µg, 500 to 1750 µg, 500 to 2000 µg, 500 to 2250 µg, 500 to 2500 µg, 500 to 2750 µg, 500 to 3000 µg, 600 to 700 µg, 600 to 800 µg, 600 to 900 µg, 600 to 1000 µg, 600 to 1250 µg, 600 to 1500 µg, 600 to 1750 µg, 600 to 2000 µg, 600 to 2250 µg, 600 to 2500 µg, 600 to 2750 µg, 600 to 3000 µg, 700 to 800 µg, 700 to 900 µg, 700 to 1000 µg, 700 to 1250 µg, 700 to 1500 µg, 700 to 1750 µg, 700 to 2000 µg, 700 to 2250 µg, 700 to 2500 µg, 700 to 2750 µg, 700 to 3000 µg, 800 to 900 µg, 800 to 1000 µg, 800 to 1250 µg, 800 to 1500 µg, 800 to 1750 µg, 800 to 2000 µg, 800 to 2250 µg, 800 to 2500 µg, 800 to 2750 µg, 800 to 3000 µg, 900 to 1000 µg, 900 to 1250 µg, 900 to 1500 µg, 900 to 1750 µg, 900 to 2000 µg, 900 to 2250 µg, 900 to 2500 µg, 900 to 2750 µg, 900 to 3000 µg, 1000 to 1250 µg, 1000 to 1500 µg, 1000 to 1750 µg, 1000 to 2000 µg, 1000 to 2250 µg, 1000 to 2500 µg, 1000 to 2750 µg, 1000 to 3000 µg, 2 to 500 µg, 50 to 500 µg, 3 to 100 µg, 5 to 20 µg, 5 to 100 µg, 10 µg, 20 µg, 30 µg, 40 µg, 50 µg, 60 µg, 70 µg, 75 µg, 80 µg, 90 µg, 100 µg, 150 µg, 200 µg, 250 µg, 300 µg, 350 µg, 400 µg, 450 µg, 500 µg, 550 µg, 600 µg, 650 µg, 700 µg, 750 µg, 800 µg, 850 µg, 900 µg, 950 µg, 1000 µg, 1050 µg, 1100 µg, 1150 µg, 1200 µg, 1250 µg, 1300 µg, 1350 µg, 1400 µg, 1450 µg, 1500 µg, 1550 µg, 1600 µg, 1650 µg, 1700 µg, 1750 µg, 1800 µg, 1850 µg, 1900 µg, 1950 µg, 2000 µg, 2050 µg, 2100 µg, 2150 µg, 2200 µg, 2250 µg, 2300 µg, 2350 µg, 2400 µg, 2450 µg, 2500 µg, 2550 µg, 2600 µg, 2650 µg, 2700 µg, 2750 µg, 2800 µg, 2850 µg, 2900 µg, 2950 µg, 3000 µg, 3250 µg, 3500 µg, 3750 µg, 4000 µg, 4250 µg, 4500 µg, 4750 µg, 5000 µg of a GCC agonist described herein.

When provided as a single dosage form, the potential exists for a chemical interaction between the combined active ingredients (for example, an opioid and a GCC agonist). For this reason, the preferred dosage forms of the combination products of this disclosure are formulated such that although the active ingredients are combined in a single dosage form, the physical contact between the active ingredients is minimized (that is, reduced).

In order to minimize contact, one embodiment of this disclosure where the product is orally administered provides for a combination product wherein one active ingredient is enteric coated. By enteric coating one or more of the active ingredients, it is possible not only to minimize the contact between the combined active ingredients, but also, it is possible to control the release of one of these components in the gastrointestinal tract such that one of these components is not released in the stomach but rather is released in the intestines. Another embodiment of this disclosure where oral administration is desired provides for a combination product wherein one of the active ingredients is coated with a sustained-release material which effects a sustained-release throughout the gastrointestinal tract and also serves to minimize physical contact between the combined active ingredients. Furthermore, the sustained-released component can be additionally enteric coated such that the release of this component occurs only in the intestine. Still another approach would involve the formulation of a combination product in which the one component is coated with a sustained and/or enteric release polymer, and the other component is also coated with a polymer such as a low-viscosity grade of hydroxypropyl methylcellulose (HPMC) or other appropriate materials as known in the art, in order to further separate the active components. The polymer coating serves to form an additional barrier to interaction with the other component.

Dosage forms of the combination products include those wherein one active ingredient is enteric coated can be in the form of tablets such that the enteric coated component and the other active ingredient are blended together and then compressed into a tablet or such that the enteric coated component is compressed into one tablet layer and the other active ingredient is compressed into an additional layer. Optionally, in order to further separate the two layers, one or more placebo layers may be present such that the placebo layer is between the layers of active ingredients. In addition, dosage forms of the present disclosure can be in the form of capsules wherein one active ingredient is compressed into a tablet or in the form of a plurality of microtablets, particles, granules or non-perils, which are then enteric coated. These enteric coated microtablets, particles, granules or non-perils are then placed into a capsule or compressed into a capsule along with a granulation of the other active ingredient.

These as well as other ways of minimizing contact between the components of combination products of the present disclosure, whether administered in a single dosage form or administered in separate forms but at the same time by the same manner, will be readily apparent to those skilled in the art in light of the present disclosure.

Analgesic Agents in Combitherapy

The peptides and agonists described herein can be used in combination therapy with an analgesic agent, e.g., an analgesic compound or an analgesic peptide. These peptides and compounds can be administered with the peptides described herein (simultaneously or sequentially). They can also be optionally covalently linked or attached to an agent described herein to create therapeutic conjugates. Among the useful analgesic agents are: Ca channel blockers, 5HT receptor antagonists (for example 5HT3, 5HT4 and 5HT1 receptor antagonists), opioid receptor agonists (loperamide, fedotozine, and fentanyl), NK1 receptor antagonists, CCK receptor agonists (e.g., loxiglumide), NK1 receptor antagonists, NK3 receptor antagonists, norepinephrine-serotonin reuptake inhibitors (NSR1), vanilloid and cannabanoid receptor agonists, and sialorphin. Analgesics agents in the various classes are described in the literature.

Among the useful analgesic peptides are sialorphin-related peptides, including those comprising the amino acid sequence QHNPR (SEQ ID NO:22), including: VQHNPR (SEQ ID NO:23); VRQHNPR (SEQ ID NO: 24); VRGQHNPR (SEQ ID NO:25); VRGPQHNPR (SEQ ID NO:26); VRGPRQHNPR (SEQ ID NO:27); VRGPRRQHNPR (SEQ ID NO:28); and RQHNPR (SEQ ID NO:29). Sialorphin-related peptides bind to neprilysin and inhibit neprilysin-mediated breakdown of substance P and Met-enkephalin. Thus, compounds or peptides that are inhibitors of neprilysin are useful analgesic agents which can be administered with the peptides described herein in a co-therapy or linked to the peptides described herein, e.g., by a covalent bond. Sialophin and related peptides are described in U.S. Pat. No. 6,589,750; U.S. 20030078200 A1; and WO 02/051435 A2.

Opioid receptor antagonists and agonists can be administered with the peptides described herein in co-therapy or linked to the agent described herein, e.g., by a covalent bond. For example, opioid receptor antagonists such as naloxone, naltrexone, methyl nalozone, nalmefene, cypridime, beta funaltrexamine, naloxonazine, naltrindole, and nor-binaltorphimine are thought to be useful in the treatment of IBS. It can be useful to formulate opioid antagonists of this type is a delayed and sustained release formulation such that initial release of the antagonist is in the mid to distal small intestine and/or ascending colon. Such antagonists are described in WO 01/32180 A2. Enkephalin pentapeptide (HOE825; Tyr-D-Lys-Gly-Phe-L-homoserine; SEQ ID NO:30) is an agonist of the mu and delta opioid receptors and is thought to be useful for increasing intestinal motility (Eur. J. Pharm. 219: 445, 1992), and this peptide can be used in conjunction with the peptides described herein. Also useful is trimebutine which is thought to bind to mu/delta/kappa opioid receptors and activate release of motilin and modulate the release of gastrin, vasoactive intestinal peptide, gastrin and glucagons. Kappa opioid receptor agonists such as fedotozine, asimadoline, and ketocyclazocine, and compounds described in WO 03/097051 and WO05/007626 can be used with or linked to the peptides described herein. In addition, mu opioid receptor agonists such as morphine, diphenyloxylate, frakefamide (H-Tyr-D-Ala-Phe(F)-Phe-NH2; WO 01/019849 A1) and loperamide can be used.

Tyr-Arg (kyotorphin) is a dipeptide that acts by stimulating the release of met-enkephalins to elicit an analgesic effect (J. Biol. Chem. 262:8165, 1987). Kyotorphin can be used with or linked to the peptides described herein.

Chromogranin-derived peptide (CgA 47-66; see, e.g., Ghia et al. 2004 Regulatory Peptides 119:199) can be used with or linked to the peptides described herein.

CCK receptor agonists such as caerulein from amphibians and other species are useful analgesic agents that can be used with or linked to the peptides described herein.

Conotoxin peptides represent a large class of analgesic peptides that act at voltage gated Ca channels, NMDA receptors or nicotinic receptors. These peptides can be used with or linked to the peptides described herein.

Peptide analogs of thymulin (FR Application 2830451) can have analgesic activity and can be used with or linked to the peptides described herein.

CCK (CCKa or CCKb) receptor antagonists, including loxiglumide and dexloxiglumide (the R-isomer of loxiglumide) (WO 88/05774) can have analgesic activity and can be used with or linked to the peptides described herein.

Other useful analgesic agents include 5-HT4 agonists such as tegaserod (Zelnorm®), mosapride, metoclopramide, zacopride, cisapride, renzapride, benzimidazolone derivatives such as BIMU 1 and BIMU 8, and lirexapride. Such agonists are described in: EP1321142 A1, WO 03/053432A1, EP 505322 A1, EP 505322 B1, U.S. Pat. No. 5,510,353, EP 507672 A1, EP 507672 B1, and U.S. Pat. No. 5,273,983.

Calcium channel blockers such as ziconotide and related compounds described in, for example, EP625162B1, U.S. Pat. No. 5,364,842, U.S. Pat. No. 5,587,454, U.S. Pat. No. 5,824,645, U.S. Pat. No. 5,859,186, U.S. Pat. No. 5,994,305, U.S. Pat. No. 6,087,091, U.S. Pat. No. 6,136,786, WO 93/13128A1, EP 1336409 A1, EP 835126 A1, EP 835126 B1, U.S. Pat. No. 5,795,864, U.S. Pat. No. 5,891,849, U.S. Pat. No. 6,054,429, WO 97/01351 A1, can be used with or linked to the peptides described herein.

Various antagonists of the NK-1, NK-2, and NK-3 receptors (for a review see Giardina et al. 2003 Drugs 6:758) can be can be used with or linked to the peptides described herein.

NK1 receptor antagonists such as: aprepitant (Merck & Co Inc), vofopitant, ezlopitant (Pfizer, Inc.), R-673 (Hoffmann-La Roche Ltd), SR-48968 (Sanofi Synthelabo), CP-122,721 (Pfizer, Inc.), GW679769 (Glaxo Smith Kline), TAK-637 (Takeda/Abbot), SR-14033, and related compounds described in, for example, EP 873753 A1, US 20010006972 A1, US 20030109417A1, WO 01/52844A1, can be used with or linked to the peptides described herein.

NK-2 receptor antagonists such as nepadutant (Menarini Ricerche SpA), saredutant (Sanofi-Synthelabo), GW597599 (Glaxo Smith Kline), SR-144190 (Sanofi-Synthelabo) and UK-290795 (Pfizer Inc) can be used with or linked to the peptides described herein.

NK3 receptor antagonists such as osanetant (SR-142801; Sanofi-Synthelabo), SSR-241586, talnetant and related compounds described in, for example, WO 02/094187 A2, EP 876347 A1, WO 97/21680 A1, U.S. Pat. No. 6,277,862, WO 98/11090, WO 95/28418, WO 97/19927, and Boden et al. (J Med. Chem. 39:1664-75, 1996) can be used with or linked to the peptides described herein.

Norepinephrine-serotonin reuptake inhibitors (NSR1) such as milnacipran and related compounds described in WO 03/077897 A1 can be used with or linked to the peptides described herein.

Vanilloid receptor antagonists such as arvanil and related compounds described in WO 01/64212 A1 can be used with or linked to the peptides described herein.

The analgesic peptides and compounds can be administered with the peptides and agonists described herein (simultaneously or sequentially). The analgesic agents can also be covalently linked to the peptides and agonists described herein to create therapeutic conjugates. Where the analgesic is a peptide and is covalently linked to an agent described herein the resulting peptide may also include at least one trypsin cleavage site. When present within the peptide, the analgesic peptide may be preceded by (if it is at the carboxy terminus) or followed by (if it is at the amino terminus) a trypsin cleavage site that allows release of the analgesic peptide.

In addition to sialorphin-related peptides, analgesic peptides include: AspPhe, endomorphin-1, endomorphin-2, nocistatin, dalargin, lupron, ziconotide, and substance P.

Diabetes, Obesity and Other Disorders

Pharmaceutical compositions comprising at least two of: 1) an agent that stimulates the production of cAMP (e.g., glucagon-like peptide 1 (GLP-1)); 2) an agent that inhibits the degradation of a cyclic nucleotide (e.g., a phosphodiesterase inhibitor); and 3) a peptide or agonist described herein useful for treating diabetes and obesity. Such compositions may also be useful for treating secondary hyperglycemias in connection with pancreatic diseases (chronic pancreatitis, pancreasectomy, hemochromatosis) or endocrine diseases (acromegaly, Cushing's syndrome, pheochromocytoma or hyperthyreosis), drug-induced hyperglycemias (benzothiadiazine saluretics, diazoxide or glucocorticoids), pathologic glucose tolerance, hyperglycemias, dyslipoproteinemias, adiposity, hyperlipoproteinemias and/or hypotensions.

The phosphodiesterase inhibitor can be specific for a particular phosphodiesterase (e.g., Group III or Group IV) or a non-specific phosphodiesterase inhibitor, such as papaverine, theophylline, enprofyllines and/or IBMX. Specific phosphodiesterase inhibitors which inhibit group III phosphodiesterases (cGMP-inhibited phosphodiesterases), including indolidane (LY195115), cilostamide (OPC 3689), lixazinone (RS 82856), Y-590, imazodane (CI914), SKF 94120, quazinone, ICI 153,110, cilostazole, bemorandane (RWJ 22867), siguazodane (SK&F 94-836), adibendane (BM 14,478), milrinone (WIN 47203), enoximone (MDL 17043), pimobendane (UD-CG 115), MCI-154, saterinone (BDF 8634), sulmazole (ARL 115), UD-CG 212, motapizone, piroximone, and ICI-118233 can be useful. In addition, phosphodiesterase inhibitors which inhibit group IV phosphodiesterases (cAMP-specific phosphodiesterases), such as rolipram ZK 62711; pyrrolidone), imidazolidinone (RO 20-1724), etazolate (SQ 65442), denbufylline (BRL 30892), ICI63197, and RP73401 can be used.

Other Agents for Use in Combitherapy

Also within the disclosure are pharmaceutical compositions comprising a peptide or agonists described herein and a second therapeutic agent. The second therapeutic agent can be administered to treat any condition for which it is useful, including conditions that are not considered to be the primary indication for treatment with the second therapeutic agent. The second therapeutic agent can be administered simultaneously or sequentially. The second therapeutic agent can be covalently linked to the peptides and agonists described herein to create a therapeutic conjugate. When the second therapeutic agent is another peptide, a linker including those described herein may be used between the peptide described herein and the second therapeutic peptide.

Examples of therapeutic agents used to treat heart failure include diuretics (e.g. furesomide (Lasix), bumetanide (Bumex), ethacrynic acid (Edecrin), torsemide (Demadex), amiloride (Midamor), spironolactone (Aldactone), chorthiazide (Diuril), metolazone (Zaroxylyn)), Angiotension-Converting Enzyme (ACE) inhibitors (e.g. captopril (Capoten), enalopril (Vasotec), lisinopril (Prinivil, Zestril), ramipril (Altace)), Beta blockers (e.g. carvedilol (Coreg) and Inotropes (e.g. digoxin, dobutaimine, dopamine Milrinone).

Examples of additional therapeutic agents to treat gastrointestinal and other disorders include:

agents to treat constipation (e.g., a chloride channel activator such as the bicylic fatty acid, Lubiprostone (formerly known as SPI-0211; Sucampo Pharmaceuticals, Inc.; Bethesda, Md.), a laxative (eg. a bulk-forming laxative (e.g. nonstarch polysaccharides, Colonel Tablet (polycarbophil calcium), Plantago Ovata®, Equalactin® (Calcium Polycarbophil)), fiber (e.g. FIBERCON® (Calcium Polycarbophil), an osmotic laxative, a stimulant laxative (such as diphenylmethanes (e.g. bisacodyl), anthraquinones (e.g. cascara, senna), and surfactant laxatives (e.g. castor oil, docusates), an emollient/lubricating agent (such as mineral oil, glycerine, and docusates), MiraLax (Braintree Laboratories, Braintree Mass.), dexloxiglumide (Forest Laboratories, also known as CR 2017 Rottapharm (Rotta Research Laboratorium SpA)), saline laxatives, enemas, suppositories, and CR 3700 (Rottapharm (Rotta Research Laboratorium SpA); acid reducing agents such as proton pump inhibitors (e.g., omeprazole (Prilosec®), esomeprazole (Nexium®), lansoprazole (Prevacid®), pantoprazole (Protonix®) and rabeprazole (Aciphex®)) and Histamine H2-receptor antagonist (also known as H2 receptor blockers including cimetidine, ranitidine, famotidine and nizatidine);

prokinetic agents including itopride, octreotide, bethanechol, metoclopramide (Reglan®), domperidone (Motilium®), erythromycin (and derivatives thereof) or cisapride (Propulsid®);

prokineticin peptides homologs, variants and chimeras thereof including those described in U.S. Pat. No. 7,052,674 which can be used with or linked to the peptides described herein; pro-motility agents such as the vasostatin-derived peptide, chromogranin A (4-16) (see, e.g., Ghia et al. 2004 Regulatory Peptides 121:31) or motilin agonists (e.g., GM-611 or mitemcinal fumarate) or nociceptin/Orphanin FQ receptor modulators (US20050169917);

other peptides which can bind to and/or activate GC-C including those described in US20050287067;

complete or partial 5HT (e.g. 5HT1, 5HT2, 5HT3, 5HT4) receptor agonists or antagonists (including 5HT1A antagonists (e.g. AGI-001 (AGI therapeutics), 5HT2B antagonists (e.g. PGN1091 and PGN1164 (Pharmagene Laboratories Limited), and 5HT4 receptor agonists (such as tegaserod (ZELNORM®), prucalopride, mosapride, metoclopramide, zacopride, cisapride, renzapride, benzimidazolone derivatives such as BIMU 1 and BIMU 8, and lirexapride). Such agonists/modulatos are described in: EP1321142 A1, WO 03/053432A1, EP 505322 A1, EP 505322 B1, U.S. Pat. No. 5,510,353, EP 507672 A1, EP 507672 B1, U.S. Pat. No. 5,273,983, and U.S. Pat. No. 6,951,867); 5HT3 receptor agonists such as MKC-733; and 5HT3 receptor antagonists such as DDP-225 (MCI-225; Dynogen Pharmaceuticals, Inc.), cilansetron (Calmactin®), alosetron (Lotronex®), Ondansetron HCl (Zofrane), Dolasetron (ANZEMET®), palonosetron (Aloxi®), Granisetron (Kytril®), YM060(ramosetron; Astellas Pharma Inc.; ramosetron may be given as a daily dose of 0.002 to 0.02 mg as described in EP01588707) and ATI-7000 (Aryx Therapeutics, Santa Clara Calif.);

muscarinic receptor agonists;

anti-inflammatory agents;

antispasmodics including but not limited to anticholinergic drugs (like dicyclomine (e.g. Colimex®, Formulex®, Lomine®, Protylol®, Viscerol®, Spasmoban®, Bentyl®, Bentylol®), hyoscyamine (e.g. IB-Stat®, Nulev®, Levsin®, Levbid®, Levsinex Timecaps®, Levsin/SL®, Anaspaz®, A-Spas S/L®, Cystospaz®, Cystospaz-M®, Donnamar®, Colidrops Liquid Pediatric®, Gastrosed®, Hyco Elixir®, Hyosol®, Hyospaz®, Hyosyne®, Losamine®, Medispaz®, Neosol®, Spacol®, Spasdel®, Symax®, Symax SL®), Donnatal (e.g. Donnatal Extentabs®), clidinium (e.g. Quarzan, in combination with Librium=Librax), methantheline (e.g. Banthine), Mepenzolate (e.g. Cantil), homatropine (e.g. hycodan, Homapin), Propantheline bromide (e.g. Pro-Banthine), Glycopyrrolate (e.g. Robinul®, Robinul Forte®), scopolamine (e.g. Transderm-Scop®, Transderm-V®), hyosine-N-butyl-bromide (e.g. Buscopan®), Pirenzepine (e.g. Gastrozepin®) Propantheline Bromide (e.g. Propanthel®), dicycloverine (e.g. Merbentyl®), glycopyrronium bromide (e.g. Glycopyrrolate®), hyoscine hydrobromide, hyoscine methobromide, methanthelinium, and octatropine); peppermint oil; and direct smooth muscle relaxants like cimetropium bromide, mebeverine (DUSPATAL®, DUSPATALIN®, COLOFAC MR®, COLOTAL®), otilonium bromide (octilonium), pinaverium (e.g. Dicetel® (pinaverium bromide; Solvay S.A.)), Spasfon® (hydrated phloroglucinol and trimethylphloroglucinol) and trimebutine (including trimebutine maleate (Modulon®); antidepressants, including but not limited to those listed herein, as well as tricyclic antidepressants like amitriptyline (Elavil®), desipramine (Norpramin®), imipramine (Tofranil®), amoxapine (Asendin®), nortriptyline; the selective serotonin reuptake inhibitors (SSRI's) like paroxetine (Paxil®), fluoxetine (Prozac®), sertraline (Zoloft®), and citralopram (Celexa®); and others like doxepin (Sinequan®) and trazodone (Desyrel®);

centrally-acting analgesic agents such as opioid receptor agonists, opioid receptor antagonists (e.g., naltrexone);

agents for the treatment of Inflammatory bowel disease;

agents for the treatment of Crohn's disease and/or ulcerative colitis (e.g., alequel (Enzo Biochem, Inc.; Farmingsale, N.Y.), the anti-inflammatory peptide RDP58 (Genzyme, Inc.; Cambridge, Mass.), and TRAFICET-EN™ (ChemoCentryx, Inc.; San Carlos, Calif.);

agents that treat gastrointestinal or visceral pain;

agents that increase cGMP levels (as described in US20040121994) like adrenergic receptor antagonists, dopamine receptor agonists and PDE (phosphodiesterase) inhibitors including but not limited to those disclosed herein;

purgatives that draw fluids to the intestine (e.g., VISICOL®, a combination of sodium phosphate monobasic monohydrate and sodium phosphate dibasic anhydrate);

Corticotropin Releasing Factor (CRF) receptor antagonists (including NBI-34041 (Neurocrine Biosciences, San Diego, Calif.), CRH9-41, astressin, R121919 (Janssen Pharmaceutica), CP154,526, NBI-27914, Antalarmin, DMP696 (Bristol-Myers Squibb) CP-316,311 (Pfizer, Inc.), SB723620 (GSK), GW876008 (Neurocrine/Glaxo Smith Kline), ONO-2333Ms (Ono Pharmaceuticals), TS-041 (Janssen), AAG561 (Novartis) and those disclosed in U.S. Pat. No. 5,063,245, U.S. Pat. No. 5,861,398, US20040224964, US20040198726, US20040176400, US20040171607, US20040110815, US20040006066, and US20050209253);

glucagon-like peptides (glp-1) and analogues thereof (including exendin-4 and GTP-010 (Gastrotech Pharma A)) and inhibitors of DPP-IV (DPP-IV mediates the inactivation of glp-1);

tofisopam, enantiomerically-pure R-tofisopam, and pharmaceutically-acceptable salts thereof (US 20040229867);

tricyclic anti-depressants of the dibenzothiazepine type including but not limited to Dextofisopam® (Vela Pharmaceuticals), tianeptine (Stablon®) and other agents described in U.S. Pat. No. 6,683,072;

(E)-4 (1,3bis(cyclohexylmethyl)-1,2,34,-tetrahydro-2,6-diono-9H-purin-8-yl)cinnamic acid nonaethylene glycol methyl ether ester and related compounds described in WO 02/067942;

the probiotic PROBACTRIX® (The BioBalance Corporation; New York, N.Y.) which contains microorganisms useful in the treatment of gastrointestinal disorders;

antidiarrheal drugs including but not limited to loperamide (Imodium, Pepto Diarrhea), diphenoxylate with atropine (Lomotil, Lomocot), cholestyramine (Questran, Cholybar), atropine (Co-Phenotrope, Diarsed, Diphenoxylate, Lofene, Logen, Lonox, Vi-Atro, atropine sulfate injection) and Xifaxan® (rifaximin; Salix Pharmaceuticals Ltd), TZP-201 (Tranzyme Pharma Inc.), the neuronal acetylcholine receptor (nAChR) blocker AGI-004 (AGI therapeutics), and bismuth subsalicylate (Pepto-bismol);

anxiolytic drugs including but not limited to Ativan (lorazepam), alprazolam (Xanax®), chlordiazepoxide/clidinium (Librium®, Librax®), clonazepam (Klonopin®), clorazepate (Tranxene®), diazepam (Valium®), estazolam (ProSom®), flurazepam (Dalmane®), oxazepam (Serax®), prazepam (Centrax®), temazepam (Restoril®), triazolam (Halcion®;

Bedelix® (Montmorillonite beidellitic; Ipsen Ltd), Solvay SLV332 (ArQule Inc), YKP (SK Pharma), Asimadoline (Tioga Pharmaceuticals/Merck), AGI-003 (AGI Therapeutics);

neurokinin antagonists including those described in US20060040950;

potassium channel modulators including those described in U.S. Pat. No. 7,002,015;

the serotonin modulator AZD7371 (AstraZeneca Plc);

M3 muscarinic receptor antagonists such as darifenacin (Enablex; Novartis AG and zamifenacin (Pfizer);

herbal and natural therapies including but not limited to acidophilus, chamomile tea, evening primrose oil, fennel seeds, wormwood, comfrey, and compounds of Bao-Ji-Wan (magnolol, honokiol, imperatorin, and isoimperatorin) as in U.S. Pat. No. 6,923,992; and compositions comprising lysine and an anti-stress agent for the treatment of irritable bowel syndrome as described in EP01550443.

The peptides and agonists described herein can be used in combination therapy with insulin and related compounds including primate, rodent, or rabbit insulin including biologically active variants thereof including allelic variants, more preferably human insulin available in recombinant form. Sources of human insulin include pharmaceutically acceptable and sterile formulations such as those available from Eli Lilly (Indianapolis, Ind. 46285) as Humulin™ (human insulin rDNA origin). See the THE PHYSICIAN'S DESK REFERENCE, 55.sup.th Ed. (2001) Medical Economics, Thomson Healthcare (disclosing other suitable human insulins). The peptides and agonists described herein can also be used in combination therapy with agents that can boost insulin effects or levels of a subject upon administration, e.g. glipizide and/or rosiglitazone. The peptides and agonists described herein can be used in combitherapy with SYMLIN® (pramlintide acetate) and Exenatide® (synthetic exendin-4; a 39 aa peptide).

The peptides and agonists described herein can also be used in combination therapy with agents (e.g., Entereg™ (alvimopan; formerly called adolor/ADL 8-2698), conivaptan and related agents describe in U.S. Pat. No. 6,645,959) used for the treatment of postoperative ileus and other disorders.

The peptides and agonists described herein can be used in combination therapy with an anti-hypertensive agent including but not limited to:

(1) diuretics, such as thiazides, including chlorthalidone, chlorthiazide, dichlorophenamide, hydroflumethiazide, indapamide, polythiazide, and hydrochlorothiazide; loop diuretics, such as bumetanide, ethacrynic acid, furosemide, and torsemide; potassium sparing agents, such as amiloride, and triamterene; carbonic anhydrase inhibitors, osmotics (such as glycerin) and aldosterone antagonists, such as spironolactone, epirenone, and the like; (2) beta-adrenergic blockers such as acebutolol, atenolol, betaxolol, bevantolol, bisoprolol, bopindolol, carteolol, carvedilol, celiprolol, esmolol, indenolol, metaprolol, nadolol, nebivolol, penbutolol, pindolol, propanolol, sotalol, tertatolol, tilisolol, and timolol, and the like;

(3) calcium channel blockers such as amlodipine, aranidipine, azelnidipine, barnidipine, benidipine, bepridil, cinaldipine, clevidipine, diltiazem, efonidipine, felodipine, gallopamil, isradipine, lacidipine, lemildipine, lercanidipine, nicardipine, nifedipine, nilvadipine, nimodepine, nisoldipine, nitrendipine, manidipine, pranidipine, and verapamil, and the like;

(4) angiotensin converting enzyme (ACE) inhibitors such as benazepril; captopril; ceranapril; cilazapril; delapril; enalapril; enalopril; fosinopril; imidapril; lisinopril; losinopril; moexipril; quinapril; quinaprilat; ramipril; perindopril; perindropril; quanipril; spirapril; tenocapril; trandolapril, and zofenopril, and the like;

(5) neutral endopeptidase inhibitors such as omapatrilat, cadoxatril and ecadotril, fosidotril, sampatrilat, AVE7688, ER4030, and the like;

(6) endothelin antagonists such as tezosentan, A308165, and YM62899, and the like;

(7) vasodilators such as hydralazine, clonidine, minoxidil, and nicotinyl alcohol, and the like;

(8) angiotensin II receptor antagonists such as aprosartan, candesartan, eprosartan, irbesartan, losartan, olmesartan, pratosartan, tasosartan, telmisartan, valsartan, and EXP-3137, FI6828K, and RNH6270, and the like;

(9) α/β adrenergic blockers such as nipradilol, arotinolol and amosulalol, and the like;

(10) alpha 1 blockers, such as terazosin, urapidil, prazosin, tamsulosin, bunazosin, trimazosin, doxazosin, naftopidil, indoramin, WHP 164, and XEN010, and the like;

(11) alpha 2 agonists such as lofexidine, tiamenidine, moxonidine, rilmenidine and guanobenz, and the like;

(12) aldosterone inhibitors, and the like; and

(13) angiopoietin-2-binding agents such as those disclosed in WO03/030833.

Specific anti-hypertensive agents that can be used in combination with peptides and agonists described herein include, but are not limited to:

diuretics, such as thiazides (e.g., chlorthalidone, cyclothiazide (CAS RN 2259-96-3), chlorothiazide (CAS RN 72956-09-3, which may be prepared as disclosed in US2809194), dichlorophenamide, hydroflumethiazide, indapamide, polythiazide, bendroflumethazide, methyclothazide, polythiazide, trichlormethazide, chlorthalidone, indapamide, metolazone, quinethazone, althiazide (CAS RN 5588-16-9, which may be prepared as disclosed in British Patent No. 902,658), benzthiazide (CAS RN 91-33-8, which may be prepared as disclosed in U.S. Pat. No. 3,108,097), buthiazide (which may be prepared as disclosed in British Patent Nos. 861,367), and hydrochlorothiazide), loop diuretics (e.g. bumetanide, ethacrynic acid, furosemide, and torasemide), potassium sparing agents (e.g. amiloride, and triamterene (CAS Number 396-01-0)), and aldosterone antagonists (e.g. spironolactone (CAS Number 52-01-7), epirenone, and the like); 13-adrenergic blockers such as Amiodarone (Cordarone, Pacerone), bunolol hydrochloride (CAS RN 31969-05-8, Parke-Davis), acebutolol (±N-[3-Acetyl-4-[2-hydroxy-3-[(1 methylethyl)amino]propoxy]phenyl]-butanamide, or (±)-3'-Acetyl-4'-[2-hydroxy-3-(isopropylamino) propoxy] butyranilide), acebutolol hydrochloride (e.g. Sectral®, Wyeth-Ayerst), alprenolol hydrochloride (CAS RN 13707-88-5 see Netherlands Patent Application No. 6,605,692), atenolol (e.g. Tenormin®, AstraZeneca), carteolol hydrochloride (e.g. Cartrol® Filmtab®, Abbott), Celiprolol hydrochloride (CAS RN 57470-78-7, also see in U.S. Pat. No. 4,034,009), cetamolol hydrochloride (CAS RN 77590-95-5, see also U.S. Pat. No. 4,059,622), labetalol hydrochloride (e.g. Normodyne®, Schering), esmolol hydrochloride (e.g. Brevibloc®, Baxter), levobetaxolol hydrochloride (e.g. Betaxon™ Ophthalmic Suspension, Alcon), levobunolol hydrochloride (e.g. Betagan® Liquifilm® with C CAP® Compliance Cap, Allergan), nadolol (e.g. Nadolol, Mylan), practolol (CAS RN 6673-35-4, see also U.S. Pat. No. 3,408,387), propranolol hydrochloride (CAS RN 318-98-9), sotalol hydrochloride (e.g. Betapace AF™, Berlex), timolol (2-Propanol, 1-[(1,1-dimethylethyl)amino]-3-[[4-4(4-morpholinyl)-1,2,5-thiadiazol-3-yl]oxy]-, hemihydrate, (S)-, CAS RN 91524-16-2), timolol maleate (S)-1-[(1,1-dimethylethyl) amino]-3-[[4-(4-morpholinyl)-1,2,5-thiadiazol-3-yl]oxy]-2-propanol (Z)-2-butenedioate (1:1) salt, CAS RN 26921-17-5), bisoprolol (2-Propanol, 1-[4-[[2-(1-methylethoxy) ethoxy]-methyl]phenoxyl]-3-[(1-meth-ylethyl)amino]-, (±), CAS RN 66722-44-9), bisoprolol fumarate (such as (±)-1-[4-[[2-(1-Methylethoxy) ethoxy]methyl]phenoxy]-3-[(1-methylethyl)amino]-2-propanol (E)-2-butenedioate (2:1) (salt), e.g., Zebeta™, Lederle Consumer), nebivalol (2H-1-Benzopyran-2-methanol, αα'-[iminobis(methylene)]bis[6-fluoro-3,4-dihydro-, CAS RN 99200-09-6 see also U.S. Pat. No. 4,654,362), cicloprolol hydrochloride, such 2-Propanol, 1-[4-[2-(cyclopropylmethoxy)ethoxy]phenoxy]-3-[1-methylethyl)amino]-, hydrochloride, A.A.S. RN 63686-79-3), dexpropranolol hydrochloride (2-Propanol, 1-[1-methylethy)-amino]-3-(1-naphthalenyloxy)-hydrochloride (CAS RN 13071-11-9), diacetolol hydrochloride (Acetamide, N-[3-acetyl-4-[2-hydroxy-3-[(1-methyl-ethyl)amino]propoxy][phenyl]-, monohydrochloride CAS RN 69796-04-9), dilevalol hydrochloride (Benzamide, 2-hydroxy-5-[1-hydroxy-2-[1-methyl-3-phenylpropyl)amino]ethyl]-, monohydrochloride, CAS RN 75659-08-4), exaprolol hydrochloride (2-Propanol, 1-(2-cyclohexylphenoxy)-3-[(1-methylethyl) amino]-, hydrochloride CAS RN 59333-90-3), flestolol sulfate (Benzoic acid, 2-fluoro-,3-[[2-[aminocarbonyl)amino]-1-dimethylethyl]amino]-2-hydroxypropyl ester, (±)-sulfate (1:1) (salt), CAS RN 88844-73-9; metalol hydrochloride (Methanesulfonamide, N-[4-[1-hydroxy-2-(methylamino) propyl]phenyl]-, monohydrochloride CAS RN 7701-65-7), metoprolol 2-Propanol, 1-[4-(2-methoxyethyl)phenoxy]-3-[1-methylethyl)amino]-; CAS RN 37350-58-6), metoprolol tartrate (such as 2-Propanol, 1-[4-(2-methoxyethyl)phenoxy]-3-[(1-methylethyl)amino]-, e.g., Lopressor®, Novartis), pamatolol sulfate (Carbamic acid, [2-[4-[2-hydroxy-3-[(1-methylethyl)amino]propoxyl]phenyl]-ethyl]-, methyl ester, (±) sulfate (salt) (2:1), CAS RN 59954-01-7), penbutolol sulfate (2-Propanol, 1-(2-cyclopentylphenoxy)-3-[1,1-dimethylethyl)amino]1, (S)-, sulfate (2:1) (salt), CAS RN 38363-32-5), practolol (Acetamide, N-[4-[2-hydroxy-3-[(1-methylethyl)amino]-propoxy]phenyl]-, CAS RN 6673-35-4;) tiprenolol hydrochloride (Propanol, 1-[(1-methylethyl) amino]-3-[2-(methylthio)-phenoxy]-, hydrochloride, (±), CAS RN 39832-43-4), tolamolol (Benzamide, 4-[2-[[2-hydroxy-3-(2-methylphenoxy)-propyl]amino]ethoxyl]-, CAS RN 38103-61-6), bopindolol, indenolol, pindolol, propanolol, tertatolol, and tilisolol, and the like; calcium channel blockers such as besylate salt of amlodipine (such as 3-ethyl-5-methyl-2-(2-aminoethoxymethyl)-4-(2-chlorophenyl)-1,4-dihydro-6-methyl-3,5-pyridinedicarboxylate benzene-sulphonate, e.g., Norvasc®, Pfizer), clentiazem maleate (1,5-Benzothiazepin-4(5H)-one, 3-(acetyloxy)-8-chloro-5-[2-(dimethylamino)ethyl]-2,3-dihydro-2-(4-methoxyphenyl)-(2S-cis)-, (Z)-2-butenedioate (1:1), see also U.S. Pat. No. 4,567,195), isradipine (3,5-Pyridinedicarboxylic acid, 4-(4-benzofurazanyl)-1,4-dihydro-2,6-dimethyl-, methyl 1-methylethyl ester, (±)-4(4-benzofurazanyl)-1,4-dihydro-2,6-dimethyl-3,5-pyridinedicarboxylate, see also U.S. Pat. No. 4,466,972); nimodipine (such as is isopropyl (2-methoxyethyl) 1,4-dihydro-2,6-dimethyl-4-(3-nitrophenyl)-3,5-pyridine-dicarboxylate, e.g. Nimotop®, Bayer), felodipine (such as ethyl methyl 4-(2,3-dichlorophenyl)-1,4-dihydro-2,6-dimethyl-3,5-pyridinedicarboxylate-, e.g. Plendil® Extended- Release, AstraZeneca LP), nilvadipine (3,5-Pyridinedicarboxylic acid, 2-cyano-1,4-dihydro-6-methyl-4-(3-nitrophenyl)-, 3-methyl 5-(1-methylethyl)ester, also see U.S. Pat. No. 3,799,934), nifedipine (such as 3,5-pyridinedicarboxylic acid, 1,4-dihydro-2,6-dimethyl-4-(2-nitrophenyl)-, dimethyl ester, e.g., Procardia XL® Extended Release Tablets, Pfizer), diltiazem hydrochloride (such as 1,5-Benzothiazepin-4(5H)-one, 3-(acetyloxy)-5[2-(dimethylamino) ethyl]-2, -3-dihydro-2(4-methoxyphenyl)-, monohydrochloride, (+)-cis., e.g., Tiazac®, Forest), verapamil hydrochloride (such as benzeneacetronitrile, (alpha)-[[3-[[2-(3,4-dimethoxyphenyl)ethyl]methylamino]propyl]-3,4-dimethoxy-(alpha)-(1-methylethyl)hydrochloride, e.g., Isoptin® SR, Knoll Labs), teludipine hydrochloride (3,5-Pyridinedicarboxylic acid, 2-[(dimethylamino)methyl]4-[2-[(1E)-3-(1,1-dimethylethoxy)-3-oxo-1-propenyl]phenyl]-1, 4-dihydro-6-methyl-, diethyl ester, monohydrochloride) CAS RN 108700-03-4), belfosdil (Phosphonic acid, [2-(2-phenoxyethyl)-1,3-propane-diyl]bis-, tetrabutyl ester CAS RN 103486-79-9), fostedil (Phosphonic acid, [[4-(2-benzothiazolyl)phenyl]methyl]-, diethyl ester CAS RN 75889-62-2), aranidipine, azelnidipine, barnidipine, benidipine, bepridil, cinaldipine, clevidipine, efonidipine, gallopamil, lacidipine, lemildipine, lercanidipine, monatepil maleate (1-piperazinebutanamide, N-(6,11-dihydrodibenzo(b,e)thiepin-11-yl)$_4$-(4-fluorophenyl)-, (±)-, (Z)-2-butenedioate (1:1) (±)-N-(6,11-Dihydrodibenzo(b,e)thiep-in-11-yl)-4-(p-fluorophenyl)-1-piperazinebutyramide maleate (1:1) CAS RN 132046-06-1), nicardipine, nisoldipine, nitrendipine, manidipine, pranidipine, and the like; T-channel calcium antagonists such as mibefradil; angiotensin converting enzyme (ACE) inhibitors such as benazepril, benazepril hydrochloride (such as 3-[[1-(ethoxycarbonyl)-3-phenyl-(1S)-propyl]amino]-2,3,4,5-tetrahydro-2-oxo-1H-1-(3S)-benzazepine-1-acetic acid monohydrochloride, e.g., Lotrel®, Novartis), captopril (such as 1-[(2S)-3-mercapto-2-methylpropionyl]-L-proline, e.g., Captopril, Mylan, CAS RN 62571-86-2 and others disclosed in U.S. Pat. No. 4,046,889), ceranapril (and others disclosed in U.S. Pat. No. 4,452,790), cetapril (alacepril, Dainippon disclosed in Eur. Therap. Res. 39:671 (1986); 40:543 (1986)), cilazapril (Hoffman-LaRoche) disclosed in J. Cardiovasc. Pharmacol. 9:39 (1987), indalapril (delapril hydrochloride (21-1-1,2,4-Benzothiadiazine-7-sulfonamide, 3-bicyclo[2.2.1]hept-5-en-2-yl-6-chloro-3,4-dihydro-, 1,1-dioxide CAS RN 2259-96-3); disclosed in U.S. Pat. No. 4,385,051), enalapril (and others disclosed in U.S. Pat. No. 4,374,829), enalapril, enalaprilat, fosinopril, ((such as L-proline, 4-cyclohexyl-1-[[[2-methyl-1-(1-oxopropoxy)propoxy](4-phenylbutyl)phosphinyl] acetyl]-, sodium salt, trans-, e.g., Monopril, Bristol-Myers Squibb and others disclosed in U.S. Pat. No. 4,168,267), fosinopril sodium (L-Proline, 4-cyclohexyl-1-[[(R)-[(1S)-2-methyl-1-(1-ox-opropoxy)propox), imidapril, indolapril (Schering, disclosed in J. Cardiovasc. Pharmacol. 5:643, 655 (1983)), lisinopril (Merck), losinopril, moexipril, moexipril hydrochloride (3-Isoquinolinecarboxylic acid, 2-[(2S)-2-[[(1S)-1-(ethoxycarbonyl)-3-phenylpropyl]amino]-1-oxopropyl]-1,-2,3,4-tetrahydro-6,7-dimethoxy-, monohydrochloride, (3S)-CAS RN 82586-52-5), quinapril, quinaprilat, ramipril (Hoechsst) disclosed in EP 79022 and Curr. Ther. Res. 40:74 (1986), perindopril erbumine (such as 2S,3aS, 7aS-1-[(S)—N—[(S)-1-Carboxybutyl]alanyl]hexahydro-2-indolinecarboxylic acid, 1-ethyl ester, compound with tert-butylamine (1:1), e.g., Aceon®, Solvay), perindopril (Servier, disclosed in Eur. J. din. Pharmacol. 31:519 (1987)), quanipril (disclosed in U.S. Pat. No. 4,344,949), spirapril (Schering, disclosed in Acta. Pharmacol. Toxicol. 59 (Supp. 5):173 (1986)), tenocapril, trandolapril, zofenopril (and others disclosed in U.S. Pat. No. 4,316,906), rentiapril (fentiapril, disclosed in Clin. Exp. Pharmacol. Physiol. 10:131 (1983)), pivopril, YS980, teprotide (Bradykinin potentiator BPP9a CAS RN 35115-60-7), BRL 36,378 (Smith Kline Beecham, see EP80822 and EP60668), MC-838 (Chugai, see C.A. 102:72588v and Jap. J. Pharmacol. 40:373 (1986), CGS14824 (Ciba-Geigy, 3-([1-ethoxycarbonyl-3-phenyl-(1S)-propyl]amino)-2,3,4,5-tetrahydro-2-oxo-1-(3S)-benzazepine-1 acetic acid HCl, see U.K. Patent No. 2103614), CGS16,617 (Ciba-Geigy, 3(S)-[[(1S)-5-amino-1-carboxypentyl]amino]-2,3,4,-5-tetrahydro-2-oxo-1H-1-benzazepine-1-ethanoic acid, see U.S. Pat. No. 4,473,575), Ru 44570 (Hoechst, see Arzneimittelforschung 34:1254 (1985)), R 31-2201 (Hoffman-LaRoche see FEBS Lett. 165:201 (1984)), C1925 (Pharmacologist 26:243, 266 (1984)), WY-44221 (Wyeth, see J. Med. Chem. 26:394 (1983)), and those disclosed in US2003006922 (paragraph 28), U.S. Pat. No. 4,337,201, U.S. Pat. No. 4,432,971 (phosphonamidates); neutral endopeptidase inhibitors such as omapatrilat (Vanlev®), CGS 30440, cadoxatril and ecadotril, fasidotril (also known as aladotril or alatriopril), sampatrilat, mixanpril, and gemopatrilat, AVE7688, ER4030, and those disclosed in U.S. Pat. No. 5,362,727, U.S. Pat. No. 5,366,973, U.S. Pat. No. 5,225,401, U.S. Pat. No. 4,722,810, U.S. Pat. No. 5,223,516, U.S. Pat. No. 4,749,688, U.S. Pat. No. 5,552,397, U.S. Pat. No. 5,504,080, U.S. Pat. No. 5,612,359, U.S. Pat. No. 5,525, 723, EP0599444, EP0481522, EP0599444, EP0595610, EP0534363, EP534396, EP534492, EP0629627; endothelin antagonists such as tezosentan, A308165, and YM62899, and the like; vasodilators such as hydralazine (apresoline), clonidine (clonidine hydrochloride (1H-Imidazol-2-amine, N-(2, 6-dichlorophenyl)4,5-dihydro-, monohydrochloride CAS RN 4205-91-8), catapres, minoxidil (loniten), nicotinyl alcohol (roniacol), diltiazem hydrochloride (such as 1,5-Benzothiazepin-4(5H)-one, 3-(acetyloxy)-5[2-(dimethylamino) ethyl]-2,-3-dihydro-2(4-methoxyphenyl)-, monohydrochloride, (+)-cis, e.g., Tiazac®, Forest), isosorbide dinitrate (such as 1,4:3,6-dianhydro-D-glucitol 2,5-dinitrate e.g., Isordil® Titradose®, Wyeth-Ayerst), sosorbide mononitrate (such as 1,4:3,6-dianhydro-D-glucito-1,5-nitrate, an organic nitrate, e.g., Ismo®, Wyeth-Ayerst), nitroglycerin (such as 2,3 propanetriol trinitrate, e.g., Nitrostat® Parke-Davis), verapamil hydrochloride (such as benzeneacetonitrile, (±)-(alpha)[3-[[2-(3,4 dimethoxyphenyl)ethyl]methylamino]propyl]-3,4-dimethoxy-(alpha)-(1-methylethyl) hydrochloride, e.g., Covera HS® Extended-Release, Searle), chromonar (which may be prepared as disclosed in U.S. Pat. No. 3,282,938), clonitate (Annalen 1870 155), droprenilamine (which may be prepared as disclosed in DE2521113), lidoflazine (which may be prepared as disclosed in U.S. Pat. No. 3,267,104); prenylamine (which may be prepared as disclosed in U.S. Pat. No. 3,152,173), propatyl nitrate (which may be prepared as disclosed in French Patent No. 1,103, 113), mioflazine hydrochloride (1-piperazineacetamide, 3-(aminocarbonyl)$_4$-[4,4-bis(4-fluorophenyl)butyl]-N-(2,6-dichlorophenyl)-, dihydrochloride CAS RN 83898-67-3), mixidine (Benzeneethanamine, 3,4-dimethoxy-N-(1-methyl-2-pyrrolidinylidene)-Pyrrolidine, 2-[(3,4-dimethoxyphenethyl)imino]-1-methyl-1-Methyl-2-[(3,4-dimethoxyphenethyl)imino]pyrrolidine CAS RN 27737-38-8), molsidomine (1,2,3-Oxadiazolium, 5-[(ethoxycarbonyl) amino]-3-(4-morpholinyl)-, inner salt CAS RN 25717-80-0), isosorbide mononitrate (D-Glucitol, 1,4:3,6-dianhydro-, 5-nitrate CAS RN 16051-77-7), erythrityl tetranitrate (1,2,3, 4-Butanetetrol, tetranitrate, (2R,3S)-rel-CAS RN 7297-25-8), clonitrate(1,2-Propanediol, 3-chloro-, dinitrate (7CI, 8CI, 9CI) CAS RN 2612-33-1), dipyridamole Ethanol, 2,2',",2"-[(4,8-di-1-piperidinylpyrimido[5,4-d]pyrimidine-2,6-diyl) dinitrilo]tetrakis-CAS RN 58-32-2), nicorandil (CAS RN 65141-46-0 3-), pyridinecarboxamide (N-[2-(nitrooxy) ethyl]-Nisoldipine-3,5-Pyridinedicarboxylic acid, 1,4-dihydro-2,6-dimethyl-4-(2-nitrophenyl)-, methyl 2-methylpropyl ester CAS RN 63675-72-9), nifedipine-3,5-Pyridinedicarboxylic acid, 1,4-dihydro-2,6-dimethyl-4-(2-nitrophenyl)-, dimethyl ester CAS RN 21829-25-4), perhexyline maleate (Piperidine, 2-(2,2-dicyclohexylethyl)-, (2Z)-2-butenedioate (1:1) CAS RN 6724-53-4), oxprenolol hydrochloride (2-Propanol, 1-[(1-methylethyl)amino]-3-[2-(2-propenyloxy)phenoxy]-, hydrochloride CAS RN 6452-73-9), pentrinitrol (1,3-Propanediol, 2,2-bis[(nitrooxy)methyl]-, mononitrate (ester) CAS RN 1607-17-6), verapamil (Benzeneacetonitrile, α-[3-[[2-(3,4-dimethoxyphenyl)ethyl]-methylamino]propyl]-3,4-dimethoxy-α-(1-methylethyl)-CAS RN 52-53-9) and the like; angiotensin II receptor antagonists such as, aprosartan, zolasartan, olmesartan, pratosartan, FI6828K, RNH6270, candesartan (1H-Benzimidazole-7-carboxylic acid, 2-ethoxy-1-[[2'-(1H-tetrazol-5-yl)[1,1'-biphenyl]4-yl]methyl]-CAS RN 139481-59-7), candesartan cilexetil ((+/−)-1-(cyclohexylcarbonyloxy)ethyl-2-ethoxy-1-[[2'-(1H-tetrazol-5-yl)biphenyl-4-yl]-1H-benzimidazole carboxylate, CAS RN 145040-37-5, U.S. Pat. No. 5,703,110 and U.S. Pat. No. 5,196,444), eprosartan (3-[1-4-carboxyphenylmethyl)-2-n-butyl-imidazol-5-yl]-(2-thienylmethyl)propenoic acid, U.S. Pat. No. 5,185,351 and U.S. Pat. No. 5,650,650), irbesartan (2-n-butyl-3-[[2'-(lh-tetrazol-5-yl)biphenyl-4-yl]methyl]1, 3-diazazspiro[4,4]non-1-en-4-one, U.S. Pat. No. 5,270,317 and U.S. Pat. No. 5,352,788), losartan (2-N-butyl-4-chloro-5-hydroxymethyl-1-[(2'-(1H-tetrazol-5-yl)biphenyl-4-yl)-methyl]imidazole, potassium salt, U.S. Pat. No. 5,138,069, U.S. Pat. No. 5,153,197 and U.S. Pat. No. 5,128,355), tasosartan (5,8-dihydro-2,4-dimethyl-8-[(2'-(1H-tetrazol-5-yl)[1, 1'-biphenyl]4-yl)methyl]-pyrido[2,3-d]pyrimidin-7(6H)-one, U.S. Pat. No. 5,149,699), telmisartan (4'-[(1,4-dimethyl-2'-propyl-(2,6'-bi-1H-benzimidazol)-1'-yl)]-[1,1'-biphenyl]-2-carboxylic acid, CAS RN 144701-48-4, U.S. Pat. No. 5,591,762), milfasartan, abitesartan, valsartan (Diovan® (Novartis), (S)—N-valeryl-N4[2'-(1H-tetrazol-5-yl)biphenyl-4-yl)methyl]valine, U.S. Pat. No. 5,399,578), EXP-3137 (2-N-butyl-4-chloro-1-[(2'-(1H-tetrazol-5-yl)biphenyl-4-yl)-methyl]imidazole-5-carboxylic acid, U.S. Pat. No. 5,138, 069, U.S. Pat. No. 5,153,197 and U.S. Pat. No. 5,128,355), 3-(2'-(tetrazol-5-yl)-1,1'-biphen-4-yl)methyl-5,7-dimethyl-2-ethyl-3H-imidazo[4,5-b]pyridine, 4'[2-ethyl-4-methyl-6-(5,6,7,8-tetrahydroimidazo[1,2-a]pyridin-2-yl]-benzimidazol-1-yl]-methyl]-1,1'-biphenyl]-2-carboxylic acid, 2-butyl-6-(1-methoxy-1-methylethyl)-2-[2'-)1H-tetrazol-5-yl) biphenyl-4-ylmethyl]quinazolin-4(3H)-one, 3-[2'-carboxybiphenyl-4-yl)methyl]-2-cyclopropyl-7-methyl-3H-imidazo[4,5-b]pyridine, 2-butyl-4-chloro-1-[(2'-tetrazol-5-yl)biphenyl-4-yl)methyl]imidazole-carboxylic acid, 2-butyl-4-chloro-1-[[2'-(1H-tetrazol-5-yl)[1,1'-biphenyl]-4-yl] methyl]-1H-imidazole-5-carboxylic acid-1-(ethoxycarbonyl-oxy)ethyl ester potassium salt, dipotassium 2-butyl-4-(methylthio)-1-[[2-[[[(propylamino)carbonyl] amino]-sulfonyl](1,1'-biphenyl)-4-yl]methyl]-1H-imidazole-5-carboxylate, methyl-2-[[4-butyl-2-methyl-6-oxo-5-[[2'-(1H-tetrazol-5-yl)-[1,1'-biphenyl]-4-yl]methyl]-1-(6H)-pyrimidinyl]methyl]-3-thiophencarboxylate, 5-[(3,5-dibutyl-1H-1,2,4-triazol-1-yl)methyl]-2-[2-(1H-tetrazol-5-ylphenyl)]pyridine, 6-butyl-2-(2-phenylethyl)-5[[2'-(1H-tetrazol-5-yl)[1,1'-biphenyl]-4-methyl]pyrimidin-(4-3H)-one D,L lysine salt, 5-methyl-7-n-propyl-8-[[2'-(1H-tetrazol-5-yl)biphenyl-4-yl]methyl]-[1,2,4]-triazolo[1,5-c] pyrimidin-2(3H)-one, 2,7-diethyl-5-[[2'-(5-tetrazoly)biphenyl-4-yl]methyl]-5H-pyrazolo[1,5-b][1,2,4]triazole potassium salt, 2-[2-butyl-4,5-dihydro-4-oxo-3-[2'-(1H-tetrazol-5-yl)-4-biphenylmethyl]-3H-imidazol[4,5-c]pyridine-5-ylmethyl]benzoic acid, ethyl ester, potassium salt, 3-methoxy-2,6-dimethyl-4-[[2'(1H-tetrazol-5-yl)-1,1'-biphenyl-4-yl]methoxy]pyridine, 2-ethoxy-1-[[2'-(5-oxo-2,5-dihydro-1, 2,4-oxadiazol-3-yl)biphenyl-4-yl]methyl]-1H-benzimidazole-7-carboxylic acid, 1-[N-(2'-(1H-tetrazol-5-yl)biphenyl-4-yl-methyl)-N-valerolylaminomethyl) cyclopentane-1-carboxylic acid, 7-methyl-2n-propyl-3-[[2'1H-tetrazol-5-yl)biphenyl-4-yl]methyl]-3H-imidazo[4, 5-6]pyridine, 245-[(2-ethyl-5,7-dimethyl-3H-imidazo[4,5-b]pyridine-3-yl)methyl]-2-quinolinylisodium benzoate, 2-butyl-6-chloro-4-hydroxymethyl-5-methyl-3-[[2'-(1H-tetrazol-5-yl)biphenyl-4-yl]methyl]pyridine, 2-[[[2-butyl-1-[(4-carboxyphenyl)methyl]-1H-imidazol-5-yl]methyl] amino]benzoic acid tetrazol-5-yl)biphenyl-4-yl]methyl] pyrimidin-6-one, 4(S)-[4-(carboxymethyl)phenoxy]-N-[2 (R)-[4-(2-sulfobenzamido)imidazol-1-yl]octanoyl]-L-proline, 1-(2,6-dimethylphenyl)-4-butyl-1,3-dihydro-3-[[6-[2-(1H-tetrazol-5-yl)phenyl]-3-pyridinyl]methyl]-2H-imidazol-2-one, 5,8-ethano-5,8-dimethyl-2-n-propyl-5,6,7, 8-tetrahydro-1-[[2'(1H-tetrazol-5-yl)biphenyl-4-yl]methyl]-1H,4H-1,3,4a,8a-tetrazacyclopentanaphthalene-9-one, 4-[142'-(1,2,3,4-tetrazol-5-yl)biphen-4-yl)methylamino]-5, 6,7,8-tetrahydro-2-trifylquinazoline, 2-(2-chlorobenzoyl) imino-5-ethyl-3-[2'-(1H-tetrazole-5-yl)biphenyl-4-yl)methyl-1,3,4-thiadiazoline, 2-[5-ethyl-3-[2-(1H-tetrazole-5-yl) biphenyl-4-yl]methyl-1,3,4-thiazoline-2-ylidene] aminocarbonyl-1-cyclopentencarboxylic acid dipotassium salt, and 2-butyl-4-[N-methyl-N-(3-methylcrotonoyl) amino]-1-[[2'-(1H-tetrazol-5-yl)biphenyl-4-yl]methyl]-1H-imidzole-5-carboxylic acid 1-ethoxycarbonyloxyethyl ester, those disclosed in patent publications EP475206, EP497150, EP539086, EP539713, EP535463, EP535465, EP542059, EP497121, EP535420, EP407342, EP415886, EP424317, EP435827, EP433983, EP475898, EP490820, EP528762, EP324377, EP323841, EP420237, EP500297, EP426021, EP480204, EP429257, EP430709, EP434249, EP446062, EP505954, EP524217, EP514197, EP514198, EP514193, EP514192, EP450566, EP468372, EP485929, EP503162, EP533058, EP467207 EP399731, EP399732, EP412848, EP453210, EP456442, EP470794, EP470795, EP495626, EP495627, EP499414, EP499416, EP499415, EP511791, EP516392, EP520723, EP520724, EP539066, EP438869, EP505893, EP530702, EP400835, EP400974, EP401030, EP407102, EP411766, EP409332, EP412594, EP419048, EP480659, EP481614, EP490587, EP467715, EP479479, EP502725, EP503838, EP505098, EP505111 EP513,979 EP507594, EP510812, EP511767, EP512675, EP512676, EP512870, EP517357, EP537937, EP534706, EP527534, EP540356, EP461040, EP540039, EP465368, EP498723, EP498722, EP498721, EP515265, EP503785, EP501892, EP519831, EP532410, EP498361, EP432737, EP504888, EP508393, EP508445, EP403159, EP403158, EP425211, EP427463, EP437103, EP481448, EP488532, EP501269, EP500409, EP540400, EP005528, EP028834, EP028833, EP411507, EP425921, EP430300, EP434038, EP442473, EP443568, EP445811, EP459136, EP483683, EP518033, EP520423, EP531876, EP531874, EP392317, EP468470, EP470543, EP502314, EP529253, EP543263, EP540209, EP449699, EP465323, EP521768, EP415594, WO92/14468, WO93/08171, WO93/08169, WO91/00277, WO91/00281, WO91/14367, WO92/00067, WO92/00977, WO92/20342, WO93/04045, WO93/04046, WO91/15206, WO92/14714, WO92/09600, WO92/16552, WO93/05025, WO93/03018, WO91/07404, WO92/02508, WO92/13853, WO91/19697, WO91/11909, WO91/12001, WO91/11999, WO91/15209, WO91/15479, WO92/20687, WO92/20662, WO92/20661, WO93/01177, WO91/14679, WO91/13063, WO92/13564, WO91/17148, WO91/18888, WO91/19715, WO92/02257, WO92/04335, WO92/05161, WO92/07852, WO92/15577, WO93/03033, WO91/16313, WO92/00068, WO92/02510, WO92/09278, WO92/0179, WO92/10180, WO92/10186, WO92/10181, WO92/10097, WO92/10183, WO92/10182, WO92/10187, WO92/10184, WO92/10188, WO92/10180, WO92/10185, WO92/20651, WO93/03722, WO93/06828, WO93/03040, WO92/19211, WO92/22533, WO92/06081, WO92/05784, WO93/00341, WO92/04343, WO92/04059, U.S. Pat. No. 5,104,877, U.S. Pat. No. 5,187,168, U.S. Pat. No. 5,149,699, U.S. Pat. No. 5,185,340, U.S. Pat. No. 4,880, 804, U.S. Pat. No. 5,138,069, U.S. Pat. No. 4,916,129, U.S. Pat. No. 5,153,197, U.S. Pat. No. 5,173,494, U.S. Pat. No. 5,137,906, U.S. Pat. No. 5,155,126, U.S. Pat. No. 5,140,037, U.S. Pat. No. 5,137,902, U.S. Pat. No. 5,157,026, U.S. Pat. No. 5,053,329, U.S. Pat. No. 5,132,216, U.S. Pat. No. 5,057, 522, U.S. Pat. No. 5,066,586, U.S. Pat. No. 5,089,626, U.S. Pat. No. 5,049,565, U.S. Pat. No. 5,087,702, U.S. Pat. No. 5,124,335, U.S. Pat. No. 5,102,880, U.S. Pat. No. 5,128,327, U.S. Pat. No. 5,151,435, U.S. Pat. No. 5,202,322, U.S. Pat. No. 5,187,159, U.S. Pat. No. 5,198,438, U.S. Pat. No. 5,182, 288, U.S. Pat. No. 5,036,048, U.S. Pat. No. 5,140,036, U.S. Pat. No. 5,087,634, U.S. Pat. No. 5,196,537, U.S. Pat. No. 5,153,347, U.S. Pat. No. 5,191,086, U.S. Pat. No. 5,190,942, U.S. Pat. No. 5,177,097, U.S. Pat. No. 5,212,177, U.S. Pat. No. 5,208,234, U.S. Pat. No. 5,208,235, U.S. Pat. No. 5,212, 195, U.S. Pat. No. 5,130,439, U.S. Pat. No. 5,045,540, U.S. Pat. No. 5,041,152, and U.S. Pat. No. 5,210,204, and pharmaceutically acceptable salts and esters thereof; α/β adrenergic blockers such as nipradilol, arotinolol, amosulalol, bretylium tosylate (CAS RN: 61-75-6), dihydroergtamine mesylate (such as ergotaman-3',6',18-trione,9,-10-dihydro-12'-hydroxy-2'-methyl-5'-(phenylmethyl)-,(5'(a))-, monomethanesulfonate, e.g., DHE 45® Injection, Novartis), carvedilol (such as (±)-1-(Carbazol-4-yloxy)-3-[[2-(o-methoxyphenoxy)ethyl]amino]-2-propanol, e.g., Coreg®, SmithKline Beecham), labetalol (such as 5-[1-hydroxy-2-[(1-methyl-3-phenylpropyl)amino]ethyl]salicylamide monohydrochloride, e.g., Normodyne®, Schering), bretylium tosylate (Benzenemethanaminium, 2-bromo-N-ethyl-N,N-dimethyl-, salt with 4-methylbenzenesulfonic acid (1:1) CAS RN 61-75-6), phentolamine mesylate (Phenol, 3-[[(4,5-dihydro-1H-imidazol-2-yl)methyl](4-methylphenyl) amino]-, monomethanesulfonate (salt) CAS RN 65-28-1), solypertine tartrate (5H-1,3-Dioxolo[4,5-f]indole, 7-[2-[4-(2-methoxyphenyl)-1-piperazinyl]ethyl]-, (2R,3R)-2,3-dihydroxybutanedioate (1:1) CAS RN 5591-43-5), zolertine hydrochloride (piperazine, 1-phenyl4-[2-(1H-tetrazol-5-yl) ethyl]-, monohydrochloride (8C1, 9C1) CAS RN 7241-94-3) and the like;

α adrenergic receptor blockers, such as alfuzosin (CAS RN: 81403-68-1), terazosin, urapidil, prazosin (Minipress®), tamsulosin, bunazosin, trimazosin, doxazosin, naftopidil, indoramin, WHP 164, XEN010, fenspiride hydrochloride (which may be prepared as disclosed in U.S. Pat. No. 3,399, 192), proroxan (CAS RN 33743-96-3), and labetalol hydrochloride and combinations thereof; a 2 agonists such as methyldopa, methyldopa HCL, lofexidine, tiamenidine, moxonidine, rilmenidine, guanobenz, and the like; aldosterone inhibitors, and the like; renin inhibitors including Aliskiren (SPP100; Novartis/Speedel); angiopoietin-2-binding agents such as those disclosed in WO03/030833;

anti-angina agents such as ranolazine (hydrochloridel-piperazineacetamide, N-(2,6-dimethylphenyl)-4-[2-hydroxy-3-(2-methoxyphenoxy)propyl]-, dihydrochloride CAS RN 95635-56-6), betaxolol hydrochloride (2-Propanol, 1-[4-[2 (cyclopropylmethoxy)ethyl]phenoxy]-3-[(1-methylethyl) amino]-, hydrochloride CAS RN 63659-19-8), butoprozine hydrochloride (Methanone, [4-[3(dibutylamino)propoxy] phenyl](2-ethyl-3-indolizinyl)-, monohydrochloride CAS RN 62134-34-3), cinepazet maleatel-piperazineacetic acid, 4-[1-oxo-3-(3,4,5-trimethoxyphenyl)-2-propenyl]-, ethyl ester, (2Z)-2-butenedioate (1:1) CAS RN 50679-07-7), tosifen (Benzenesulfonamide, 4-methyl-N—[[[(1S)-1-methyl-2-phenylethyl]amino]carbonyl]-CAS RN 32295-184), verapamilhydrochloride (Benzeneacetonitrile, α-[3-[[2-(3,4-dimethoxyphenyl)ethyl]methylamino]propyl]-3,4-dimethoxy-α-(1-methylethyl)-, monohydrochloride CAS RN 152-114), molsidomine (1,2,3-Oxadiazolium, 5-[(ethoxycarbonyl)amino]-3-(4-morpholinyl)-, inner salt CAS RN 25717-80-0), and ranolazine hydrochloride (1-piperazineacetamide, N-(2,6-dimethylphenyl)$_4$-[2-hydroxy-3-(2-meth-oxyphenoxy)propyl]-, dihydrochloride CAS RN 95635-56-6); tosifen (Benzenesulfonamide, 4-methyl-N—[[[(1S)-1-methyl-2-phenylethyl]amino]carbonyl]-CAS RN 32295-184); adrenergic stimulants such as guanfacine hydrochloride (such as N-amidino-2-(2,6-dichlorophenyl) acetamide hydrochloride, e.g., Tenex® Tablets available from Robins); methyldopa-hydrochlorothiazide (such as levo-3-(3,4-dihydroxyphenyl)-2-methylalanine) combined with Hydrochlorothiazide (such as 6-chloro-3,4-dihydro-2H-1,2, 4-benzothiadiazine-7-sulfonamide 1,1-dioxide, e.g., the combination as, e.g., Aldoril® Tablets available from Merck), methyldopa-chlorothiazide (such as 6-chloro-2H-1,2,4-benzothiadiazine-7-sulfonamide 1,1-dioxide and methyldopa as described above, e.g., Aldoclor®, Merck), clonidine hydrochloride (such as 2-(2,6-dichlorophenylamino)-2-imidazoline hydrochloride and chlorthalidone (such as 2-chloro-5-(1-hydroxy-3-oxo-1-isoindolinyl) benzenesulfonamide), e.g., Combipres®, Boehringer Ingelheim), clonidine hydrochloride (such as 2-(2,6-dichlorophenylamino)-2-imidazoline hydrochloride, e.g., Catapres®, Boehringer Ingelheim), clonidine (1H-Imidazol-2-amine, N-(2,6-dichlorophenyl)4, 5-dihydro-CAS RN 4205-90-7), Hyzaar (Merck; a combination of losartan and hydrochlorothiazide), Co-Diovan (Novartis; a combination of valsartan and hydrochlorothiazide, Lotrel (Novartis; a combination of benazepril and amlodipine) and Caduet (Pfizer; a combination of amlodipine and atorvastatin), and those agents disclosed in US20030069221.

The peptides and agonists described herein can be used in combination therapy with one or more of the following agents useful in the treatment of respiratory and other disorders including but not limited to:

(1) 13-agonists including but not limited to: albuterol (PROVENTIL®, SALBUTAMOL®, VENTOLIN®), bambuterol, bitoterol, clenbuterol, fenoterol, formoterol, isoetharine (BRONKOSOL®, BRONKOMETER®), metaproterenol (ALUPENT®, METAPREL®), pirbuterol (MAXAIR®), reproterol, rimiterol, salmeterol, terbutaline (BRETHAIRE®, BRETHINE®, BRICANYL®), adrenalin, isoproterenol (ISUPREL®), epinephrine bitartrate (PRIMATENE®), ephedrine, orciprenline, fenoterol and isoetharine;

(2) steroids, including but not limited to beclomethasone, beclomethasone dipropionate, betamethasone, budesonide, bunedoside, butixocort, dexamethasone, flunisolide, fluocortin, fluticasone, hydrocortisone, methyl prednisone, mometasone, predonisolone, predonisone, tipredane, tixocortal, triamcinolone, and triamcinolone acetonide;

(3) β2-agonist-corticosteroid combinations [e.g., salmeterol-fluticasone (ADVAIR®), formoterol-budesonid (SYMBICORT®)];

(4) leukotriene D4 receptor antagonists/leukotriene antagonists/LTD4 antagonists (i.e., any compound that is capable of blocking, inhibiting, reducing or otherwise interrupting the interaction between leukotrienes and the Cys LTI receptor) including but not limited to: zafirlukast, montelukast, montelukast sodium (SINGULAIR®), pranlukast, iralukast, pobilukast, SKB-106,203 and compounds described as having LTD4 antagonizing activity described in U.S. Pat. No. 5,565,473;

(5) 5-lipoxygenase inhibitors and/or leukotriene biosynthesis inhibitors [e.g., zileuton and BAY1005 (CA registry 128253-31-6)];

(6) histamine H1 receptor antagonists/antihistamines (i.e., any compound that is capable of blocking, inhibiting, reducing or otherwise interrupting the interaction between histamine and its receptor) including but not limited to: astemizole, acrivastine, antazoline, azatadine, azelastine, astamizole, bromopheniramine, bromopheniramine maleate, carbinoxamine, carebastine, cetirizine, chlorpheniramine, chlorpheniramine maleate, cimetidine, clemastine, cyclizine, cyproheptadine, descarboethoxyloratadine, dexchlorpheniramine, dimethindene, diphenhydramine, diphenylpyraline, doxylamine succinate, doxylamine, ebastine, efletirizine, epinastine, farnotidine, fexofenadine, hydroxyzine, hydroxyzine, ketotifen, levocabastine, levocetirizine, levocetirizine, loratadine, meclizine, mepyramine, mequitazine, methdilazine, mianserin, mizolastine, noberastine, norasternizole, noraztemizole, phenindamine, pheniramine, picumast, promethazine, pynlamine, pyrilamine, ranitidine, temelastine, terfenadine, trimeprazine, tripelenamine, and triprolidine;

(7) an anticholinergic including but not limited to: atropine, benztropine, biperiden, flutropium, hyoscyamine (e.g. Levsin®; Levbid®; Levsin/SL®, Anaspaz®, Levsinex Timecaps®, NuLev®), ilutropium, ipratropium, ipratropium bromide, methscopolamine, oxybutinin, rispenzepine, scopolamine, and tiotropium;

(8) an anti-tussive including but not limited to: dextromethorphan, codeine, and hydromorphone;

(9) a decongestant including but not limited to: pseudoephedrine and phenylpropanolamine;

(10) an expectorant including but not limited to: guafenesin, guaicolsulfate, terpin, ammonium chloride, glycerol guaicolate, and iodinated glycerol;

(11) a bronchodilator including but not limited to: theophylline and aminophylline;

(12) an anti-inflammatory including but not limited to: fluribiprofen, diclophenac, indomethacin, ketoprofen, S-ketroprophen, tenoxicam;

(13) a PDE (phosphodiesterase) inhibitor including but not limited to those disclosed herein;

(14) a recombinant humanized monoclonal antibody [e.g. xolair (also called omalizumab), rhuMab, and talizumab];

(15) a humanized lung surfactant including recombinant forms of surfactant proteins SP-B, SP-C or SP-D [e.g. SURFAXIN®, formerly known as dsc-104 (Discovery Laboratories)],

(16) agents that inhibit epithelial sodium channels (ENaC) such as amiloride and related compounds;

(17) antimicrobial agents used to treat pulmonary infections such as acyclovir, amikacin, amoxicillin, doxycycline, trimethoprin sulfamethoxazole, amphotericin B, azithromycin, clarithromycin, roxithromycin, clarithromycin, cephalosporins(ceffoxitin, cetimetazole etc), ciprofloxacin, ethambutol, gentimycin, ganciclovir, imipenem, isoniazid, itraconazole, penicillin, ribavirin, rifampin, rifabutin, amantadine, rimantidine, streptomycin, tobramycin, and vancomycin;

(18) agents that activate chloride secretion through Ca++ dependent chloride channels (such as purinergic receptor (P2Y(2) agonists);

(19) agents that decrease sputum viscosity, such as human recombinant DNase 1, (Pulmozyme®);

(20) nonsteroidal anti-inflammatory agents (acemetacin, acetaminophen, acetyl salicylic acid, alclofenac, alminoprofen, apazone, aspirin, benoxaprofen, bezpiperylon, bucloxic acid, carprofen, clidanac, diclofenac, diclofenac, diflunisal, diflusinal, etodolac, fenbufen, fenbufen, fenclofenac, fenclozic acid, fenoprofen, fentiazac, feprazone, flufenamic acid, flufenisal, flufenisal, fluprofen, flurbiprofen, flurbiprofen, furofenac, ibufenac, ibuprofen, indomethacin, indomethacin, indoprofen, isoxepac, isoxicam, ketoprofen, ketoprofen, ketorolac, meclofenamic acid, meclofenamic acid, mefenamic acid, mefenamic acid, miroprofen, mofebutazone, nabumetone oxaprozin, naproxen, naproxen, niflumic acid, oxaprozin, oxpinac, oxyphenbutazone, phenacetin, phenylbutazone, phenylbutazone, piroxicam, piroxicam, pirprofen, pranoprofen, sudoxicam,tenoxican, sulfasalazine, sulindac, sulindac, suprofen, tiaprofenic acid, tiopinac, tioxaprofen, tolfenamic acid, tolmetin, tolmetin, zidometacin, zomepirac, and zomepirac); and

(21) aerosolized antioxidant therapeutics such as S-Nitrosoglutathione.

The peptides and agonists described herein can be used in combination therapy with an anti-obesity agent. Suitable such agents include, but are not limited to:

11β HSD-1 (11-beta hydroxy steroid dehydrogenase type 1) inhibitors, such as BVT 3498, BVT 2733, 3-(1-adamantyl)-4-ethyl-5-(ethylthio)-4H-1,2,4-triazole, 3-(1-adamantyl)-5-(3,4,5-trimethoxyphenyl)-4-methyl-4H-1,2,4-triazole, 3-adamantanyl-4,5,6,7,8,9,10,11,12,3a-decahydro-1,2,4-triazolo[4,3-a][1,1]annulene, and those compounds disclosed in WO01/90091, WO01/90090, WO01/90092 and WO02/072084;

5HT antagonists such as those in WO03/037871, WO03/037887, and the like;

5HT1a modulators such as carbidopa, benserazide and those disclosed in U.S. Pat. No. 6,207,699, WO03/031439, and the like;

5HT2c (serotonin receptor 2c) agonists, such as BVT933, DPCA37215, IK264, PNU 22394, WAY161503, R-1065, SB 243213 (Glaxo Smith Kline) and YM 348 and those disclosed in U.S. Pat. No. 3,914,250, WO00/77010, WO02/36596, WO02/48124, WO02/10169, WO01/66548, WO02/44152, WO02/51844, WO02/40456, and WO02/40457;

5HT6 receptor modulators, such as those in WO03/030901, WO03/035061, WO03/039547, and the like; acylestrogens, such as oleoyl-estrone, disclosed in del Mar-Grasa, M. et al., Obesity Research, 9:202-9 (2001) and Japanese Patent Application No. JP 2000256190;

anorectic bicyclic compounds such as 1426 (Aventis) and 1954 (Aventis), and the compounds disclosed in WO00/18749, WO01/32638, WO01/62746, WO01/62747, and WO03/015769;

CB 1 (cannabinoid-1 receptor) antagonist/inverse agonists such as rimonabant (Acomplia; Sanofi), SR-147778 (Sanofi), SR-141716 (Sanofi), BAY 65-2520 (Bayer), and SLV 319 (Solvay), and those disclosed in patent publications U.S. Pat. No. 4,973,587, U.S. Pat. No. 5,013,837, U.S. Pat. No. 5,081,122, U.S. Pat. No. 5,112,820, U.S. Pat. No. 5,292,736, U.S. Pat. No. 5,532,237, U.S. Pat. No. 5,624,941, U.S. Pat. No.

6,028,084, U.S. Pat. No. 6,509,367, U.S. Pat. No. 6,509,367, WO96/33159, WO97/29079, WO98/31227, WO98/33765, WO98/37061, WO98/41519, WO98/43635, WO98/43636, WO99/02499, WO00/10967, WO00/10968, WO01/09120, WO01/58869, WO01/64632, WO01/64633, WO01/64634, WO01/70700, WO01/96330, WO02/076949, WO03/006007, WO03/007887, WO03/020217, WO03/026647, WO03/026648, WO03/027069, WO03/027076, WO03/027114, WO03/037332, WO03/040107, WO03/086940, WO03/084943 and EP658546;

CCK-A (cholecystokinin-A) agonists, such as AR-R 15849, GI 181771 (GSK), JMV-180, A-71378, A-71623 and SR146131 (Sanofi), and those described in U.S. Pat. No. 5,739,106;

CNTF (Ciliary neurotrophic factors), such as GI-181771 (Glaxo-SmithKline), SR146131 (Sanofi Synthelabo), butabindide, PD170,292, and PD 149164 (Pfizer);

CNTF derivatives, such as Axokine® (Regeneron), and those disclosed in WO94/09134, WO98/22128, and WO99/43813;

dipeptidyl peptidase IV (DP-IV) inhibitors, such as isoleucine thiazolidide, valine pyrrolidide, NVP-DPP728, LAF237, P93/01, P 3298, TSL 225 (tryptophyl-1,2,3,4-tetrahydroisoquinoline-3-carboxylic acid; disclosed by Yamada et al, Bioorg. & Med. Chem. Lett. 8 (1998) 1537-1540), TMC-2A/2B/2C, CD26 inhibtors, FE 999011, P9310/K364, VIP 0177, SDZ 274-444, 2-cyanopyrrolidides and 4-cyanopyrrolidides as disclosed by Ashworth et al, Bioorg. & Med. Chem. Lett., Vol. 6, No. 22, pp 1163-1166 and 2745-2748 (1996) and the compounds disclosed patent publications. WO99/38501, WO99/46272, WO99/67279 (Probiodrug), WO99/67278 (Probiodrug), WO99/61431 (Probiodrug), WO02/083128, WO02/062764, WO03/000180, WO03/000181, WO03/000250, WO03/002530, WO03/002531, WO03/002553, WO03/002593, WO03/004498, WO03/004496, WO03/017936, WO03/024942, WO03/024965, WO03/033524, WO03/037327 and EP1258476;

growth hormone secretagogue receptor agonists/antagonists, such as NN703, hexarelin, MK-0677 (Merck), SM-130686, CP-424391 (Pfizer), LY 444,711 (Eli Lilly), L-692,429 and L-163,255, and such as those disclosed in U.S. Ser. No. 09/662,448, U.S. provisional application 60/203, 335, U.S. Pat. No. 6,358,951, US2002049196, US2002/022637, WO01/56592 and WO02/32888;

H3 (histamine H3) antagonist/inverse agonists, such as thioperamide, 3-(1H-imidazol-4-yl)propyl N-(4-pentenyl) carbamate), clobenpropit, iodophenpropit, imoproxifan, GT2394 (Gliatech), and A331440, O-[3-(1H-imidazol-4-yl) propanol]carbamates (Kiec-Kononowicz, K. et al., Pharmazie, 55:349-55 (2000)), piperidine-containing histamine H3-receptor antagonists (Lazewska, D. et al., Pharmazie, 56:927-32 (2001)), benzophenone derivatives and related compounds (Sasse, A. et al., Arch. Pharm. (Weinheim) 334: 45-52 (2001)), substituted N-phenylcarbamates (Reidemeister, S. et al., Pharmazie, 55:83-6 (2000)), and proxifan derivatives (Sasse, A. et al., J. Med. Chem. 43:3335-43 (2000)) and histamine H3 receptor modulators such as those disclosed in WO02/15905, WO03/024928 and WO03/024929;

leptin derivatives, such as those disclosed in U.S. Pat. No. 5,552,524, U.S. Pat. No. 5,552,523, U.S. Pat. No. 5,552,522, U.S. Pat. No. 5,521,283, WO96/23513, WO96/23514, WO96/23515, WO96/23516, WO96/23517, WO96/23518, WO96/23519, and WO96/23520;

leptin, including recombinant human leptin (PEG-OB, Hoffman La Roche) and recombinant methionyl human leptin (Amgen);

lipase inhibitors, such as tetrahydrolipstatin (orlistat/Xenical®), Triton WR1339, RHC80267, lipstatin, teasaponin, diethylumbelliferyl phosphate, FL-386, WAY-121898, Bay-N-3176, valilactone, esteracin, ebelactone A, ebelactone B, and RHC 80267, and those disclosed in patent publications WO01/77094, U.S. Pat. No. 4,598,089, U.S. Pat. No. 4,452, 813, U.S. Pat. No. 5,512,565, U.S. Pat. No. 5,391,571, U.S. Pat. No. 5,602,151, U.S. Pat. No. 4,405,644, U.S. Pat. No. 4,189,438, and U.S. Pat. No. 4,242,453;

lipid metabolism modulators such as maslinic acid, erythrodiol, ursolic acid uvaol, betulinic acid, betulin, and the like and compounds disclosed in WO03/011267;

Mc4r (melanocortin 4 receptor) agonists, such as CHIR86036 (Chiron), ME-10142, ME-10145, and HS-131 (Melacure), and those disclosed in PCT publication Nos. WO99/64002, WO00/74679, WO01/991752, WO01/25192, WO01/52880, WO01/74844, WO01/70708, WO01/70337, WO01/91752, WO02/059095, WO02/059107, WO02/059108, WO02/059117, WO02/06276, WO02/12166, WO02/11715, WO02/12178, WO02/15909, WO02/38544, WO02/068387, WO02/068388, WO02/067869, WO02/081430, WO03/06604, WO03/007949, WO03/009847, WO03/009850, WO03/013509, and WO03/031410;

Mc5r (melanocortin 5 receptor) modulators, such as those disclosed in WO97/19952, WO00/15826, WO00/15790, US20030092041;

melanin-concentrating hormone 1 receptor (MCHR) antagonists, such as T-226296 (Takeda), SB 568849, SNP-7941 (Synaptic), and those disclosed in patent publications WO01/21169, WO01/82925, WO01/87834, WO02/051809, WO02/06245, WO02/076929, WO02/076947, WO02/04433, WO02/51809, WO02/083134, WO02/094799, WO03/004027, WO03/13574, WO03/15769, WO03/028641, WO03/035624, WO03/033476, WO03/033480, JP13226269, and JP1437059;

mGluR5 modulators such as those disclosed in WO03/029210, WO03/047581, WO03/048137, WO03/051315, WO03/051833, WO03/053922, WO03/059904, and the like;

serotoninergic agents, such as fenfluramine (such as Pondimin® (Benzeneethanamine, N-ethyl-alpha-methyl-3-(trifluoromethyl)-, hydrochloride), Robbins), dexfenfluramine (such as Redux (Benzeneethanamine, N-ethyl-alpha-methyl-3-(trifluoromethyl)-, hydrochloride), Interneuron) and sibutramine ((Meridia®, Knoll/Reductil™) including racemic mixtures, as optically pure isomers (+) and (−), and pharmaceutically acceptable salts, solvents, hydrates, clathrates and prodrugs thereof including sibutramine hydrochloride monohydrate salts thereof, and those compounds disclosed in U.S. Pat. No. 4,746,680, U.S. Pat. No. 4,806,570, and U.S. Pat. No. 5,436,272, US20020006964, WO01/27068, and WO01/62341;

NE (norepinephrine) transport inhibitors, such as GW 320659, despiramine, talsupram, and nomifensine;

NPY 1 antagonists, such as BIBP3226, J-115814, BIBO 3304, LY-357897, CP-671906, GI-264879A, and those disclosed in U.S. Pat. No. 6,001,836, WO96/14307, WO01/23387, WO99/51600, WO01/85690, WO01/85098, WO01/85173, and WO01/89528;

NPY5 (neuropeptide Y Y5) antagonists, such as 152,804, GW-569180A, GW-594884A, GW-587081X, GW-548118X, FR235208, FR226928, FR240662, FR252384, 1229U91, GI-264879A, CGP71683A, LY-377897, LY-366377, PD-160170, SR-120562A, SR-120819A, JCF-104, and H409/22 and those compounds disclosed in patent publications U.S. Pat. No. 6,140,354, U.S. Pat. No. 6,191,160, U.S. Pat. No. 6,218,408, U.S. Pat. No. 6,258,837, U.S. Pat. No. 6,313,298, U.S. Pat. No. 6,326,375, U.S. Pat. No. 6,329,395, U.S. Pat. No. 6,335,345, U.S. Pat. No. 6,337,332, U.S. Pat. No. 6,329,395, U.S. Pat. No. 6,340,683, EP01010691, EP-01044970, WO97/19682, WO97/20820, WO97/20821, WO97/20822, WO97/20823, WO98/27063, WO00/107409, WO00/185714, WO00/185730, WO00/64880, WO00/68197, WO00/69849, WO/0113917, WO01/09120, WO01/14376, WO01/85714, WO01/85730, WO01/07409, WO01/02379, WO01/23388, WO01/23389, WO01/44201, WO01/62737, WO01/62738, WO01/09120, WO02/20488, WO02/22592, WO02/48152, WO02/49648, WO02/051806, WO02/094789, WO03/009845, WO03/014083, WO03/022849, WO03/028726 and Norman et al., J. Med. Chem. 43:4288-4312 (2000);

opioid antagonists, such as nalmefene (REVEX®), 3-methoxynaltrexone, methylnaltrexone, naloxone, and naltrexone (e.g. PT901; Pain Therapeutics, Inc.) and those disclosed in U.S. Pat. No. 6,734,188, US20050004155 and WO00/21509;

orexin antagonists, such as SB-334867-A and those disclosed in patent publications WO01/96302, WO01/68609, WO02/44172, WO02/51232, WO02/51838, WO02/089800, WO02/090355, WO03/023561, WO03/032991, and WO03/037847;

PDE inhibitors (e.g. compounds which slow the degradation of cyclic AMP (cAMP) and/or cyclic GMP (cGMP) by inhibition of the phosphodiesterases, which can lead to a relative increase in the intracellular concentration of cAMP and cGMP; possible PDE inhibitors are primarily those substances which are to be numbered among the class consisting of the PDE3 inhibitors, the class consisting of the PDE4 inhibitors and/or the class consisting of the PDE5 inhibitors, in particular those substances which can be designated as mixed types of PDE3/4 inhibitors or as mixed types of PDE3/4/5 inhibitors) such as those disclosed in patent publications DE1470341, DE2108438, DE2123328, DE2305339, DE2305575, DE2315801, DE2402908, DE2413935, DE2451417, DE2459090, DE2646469, DE2727481, DE2825048, DE2837161, DE2845220, DE2847621, DE2934747, DE3021792, DE3038166, DE3044568, EP000718, EP0008408, EP0010759, EP0059948, EP0075436, EP0096517, EP0112987, EP0116948, EP0150937, EP0158380, EP0161632, EP0161918, EP0167121, EP0199127, EP0220044, EP0247725, EP0258191, EP0272901, EP0272914, EP0294647, EP0300726, EP0335386, EP0357788, EP0389282, EP0406958, EP0426180, EP0428302, EP0435811, EP0470805, EP0482208, EP0490823, EP0506194, EP0511865, EP0527117, EP0626939, EP0664289, EP0671389, EP0685474, EP0685475, EP0685479, JP92234389, JP94329652, JP95010875, U.S. Pat. No. 4,963,561, U.S. Pat. No. 5,141,931, WO9117991, WO9200968, WO9212961, WO9307146, WO9315044, WO9315045, WO9318024, WO9319068, WO9319720, WO9319747, WO9319749, WO9319751, WO9325517, WO9402465, WO9406423, WO9412461, WO9420455, WO9422852, WO9425437, WO9427947, WO9500516, WO9501980, WO9503794, WO9504045, WO9504046, WO9505386, WO9508534, WO9509623, WO9509624, WO9509627, WO9509836, WO9514667, WO9514680, WO9514681, WO9517392, WO9517399, WO9519362, WO9522520, WO9524381, WO9527692, WO9528926, WO9535281, WO9535282, WO9600218, WO9601825, WO9602541, WO9611917, DE3142982, DE1116676, DE2162096, EP0293063, EP0463756, EP0482208, EP0579496, EP0667345 U.S. Pat. No. 6,331,543, US20050004222 (including those disclosed in formulas I-XIII and paragraphs 37-39, 85-0545 and 557-577), WO9307124, EP0163965, EP0393500, EP0510562, EP0553174, WO9501338 and WO9603399, as well as PDE5 inhibitors (such as RX-RA-69, SCH-51866, KT-734, vesnarinone, zaprinast, SKF-96231, ER-21355, BF/GP-385, NM-702 and sildenafil (Viagra™)), PDE4 inhibitors (such as etazolate, ICI63197, RP73401, imazolidinone (RO-20-1724), MEM 1414 (R1533/R1500; Pharmacia Roche), denbufylline, rolipram, oxagrelate, nitraquazone, Y-590, DH-6471, SKF-94120, motapizone, lixazinone, indolidan, olprinone, atizoram, KS-506-G, dipamfylline, BMY-43351, atizoram, arofylline, filaminast, PDB-093, UCB-29646, CDP-840, SKF-107806, piclamilast, RS-17597, RS-25344-000, SB-207499, TIBENELAST, SB-210667, SB-211572, SB-211600, SB-212066, SB-212179, GW-3600, CDP-840, mopidamol, anagrelide, ibudilast, aminone, pimobendan, cilostazol, quazinone and N-(3,5-dichloropyrid-4-yl)-3-cyclopropylmethoxy-4-difluoromethoxybenzamide, PDE3 inhibitors (such as ICI153, 100, bemorandane (RWJ 22867), MCI-154, UD-CG 212, sulmazole, ampizone, cilostamide, carbazeran, piroximone, imazodan, CI-930, siguazodan, adibendan, saterinone, SKF-95654, SDZ-MKS-492, 349-U-85, emoradan, EMD-53998, EMD-57033, NSP-306, NSP-307, revizinone, NM-702, WIN-62582 and WIN-63291, enoximone and milrinone, PDE3/4 inhibitors (such as benafentrine, trequinsin, ORG-30029, zardaverine, L-686398, SDZ-ISQ-844, ORG-20241, EMD-54622, and tolafentrine) and other PDE inhibitors (such as vinpocetin, papaverine, enprofylline, cilomilast, fenoximone, pentoxifylline, roflumilast, tadalafil (Clalis®), theophylline, and vardenafil (Levitra®);

Neuropeptide Y2 (NPY2) agonists include but are not limited to: peptide YY and fragments and variants thereof (e.g. YY3-36 (PYY3-36)(N. Engl. J. Med. 349:941, 2003; IKPEAPGE DASPEELNRY YASLRHYLNL VTRQRY (SEQ ID NO:31)) and PYY agonists such as those disclosed in WO02/47712, WO03/026591, WO03/057235, and WO03/027637;

serotonin reuptake inhibitors, such as, paroxetine, fluoxetine (Prozac™), fluvoxamine, sertraline, citalopram, and imipramine, and those disclosed in U.S. Pat. No. 6,162,805, U.S. Pat. No. 6,365,633, WO03/00663, WO01/27060, and WO01/162341;

thyroid hormone β agonists, such as KB-2611 (KaroBioBMS), and those disclosed in WO02/15845, WO97/21993, WO99/00353, GB98/284425, U.S. Provisional Application No. 60/183,223, and Japanese Patent Application No. JP 2000256190;

UCP-1 (uncoupling protein-1), 2, or 3 activators, such as phytanic acid, 4-[(E)-2-(5,6,7,8-tetrahydro-5,5,8,8-tetramethyl-2-napthalenyl)-1-propenyl]benzoic acid (TTNPB), retinoic acid, and those disclosed in WO99/00123;

β3 (beta adrenergic receptor 3) agonists, such as AJ9677/TAK677 (Dainippon/Takeda), L750355 (Merck), CP331648 (Pfizer), CL-316,243, SB 418790, BRL-37344, L-796568, BMS-196085, BRL-35135A, CGP12177A, BTA-243, GW 427353, Trecadrine, Zeneca D7114, N-5984 (Nisshin Kyorin), LY-377604 (Lilly), SR 59119A, and those disclosed in U.S. Pat. No. 5,541,204, U.S. Pat. No. 5,770,615, U.S. Pat. No. 5,491,134, U.S. Pat. No. 5,776,983, US488064, U.S. Pat. No. 5,705,515, U.S. Pat. No. 5,451,677, WO94/18161, WO95/29159, WO97/46556, WO98/04526 and WO98/32753, WO01/74782, WO02/32897, WO03/014113, WO03/016276, WO03/016307, WO03/024948, WO03/024953 and WO03/037881;

noradrenergic agents including, but not limited to, diethylpropion (such as Tenuate® (1-propanone, 2-(diethylamino)-1-phenyl-, hydrochloride), Merrell), dextroamphetamine (also known as dextroamphetamine sulfate, dexamphetamine, dexedrine, Dexampex, Ferndex, Oxydess II, Robese, Spancap #1), mazindol ((or 5-(p-chlorophenyl)-2,5-dihydro-3H-imidazo[2,1-a]isoindol-5-01) such as Sanorex®, Novartis or Mazanor®, Wyeth Ayerst), phenylpropanolamine (or Benzenemethanol, alpha-(1-aminoethyl)-, hydrochloride), phentermine ((or Phenol, 3-[[4,5-duhydro-1H-imidazol-2-yl)ethyl](4-methylphenyl)amino], monohydrochloride) such as Adipex-P®, Lemmon, FASTIN®, Smith-Kline Beecham and Ionamin®, Medeva), phendimetrazine ((or (2S,3S)-3,4-Dimethyl-2-phenylmorpholine L-(+)-tartrate (1:1)) such as Metra® (Forest), Plegine®(Wyeth-Ayerst), Prelu-2® (Boehringer Ingelheim), and Statobex® (Lemmon), phendamine tartrate (such as Thephorin® (2,3,4,9-Tetrahydro-2-methyl-9-phenyl-1H-indenol[2,1-c]pyridine L-(+)-tartrate (1:1)), Hoffmann-LaRoche), methamphetamine (such as Desoxyn®, Abbot ((S)—N, (alpha)-dimethylbenzeneethanamine hydrochloride)), and phendimetrazine tartrate (such as Bontril® Slow-Release Capsules, Amarin (–3,4-Dimethyl-2-phenylmorpholine Tartrate);

fatty acid oxidation upregulator/inducers such as Famoxin® (Genset);

monamine oxidase inhibitors including but not limited to befloxatone, moclobemide, brofaromine, phenoxathine, esuprone, befol, toloxatone, pirlindol, amiflamine, sercloremine, bazinaprine, lazabemide, milacemide, caroxazone and other certain compounds as disclosed by WO01/12176; and other anti-obesity agents such as 5HT-2 agonists, ACC (acetyl-CoA carboxylase) inhibitors such as those described in WO03/072197, alpha-lipoic acid (alpha-LA), AOD9604, appetite suppressants such as those in WO03/40107, ATL-962 (Alizyme PLC), benzocaine, benzphetamine hydrochloride (Didrex), bladderwrack (focus vesiculosus), BRS3 (bombesin receptor subtype 3) agonists, bupropion, caffeine, CCK agonists, chitosan, chromium, conjugated linoleic acid, corticotropin-releasing hormone agonists, dehydroepiandrosterone, DGAT1 (diacylglycerol acyltransferase 1) inhibitors, DGAT2 (diacylglycerol acyltransferase 2) inhibitors, dicarboxylate transporter inhibitors, ephedra, exendin-4 (an inhibitor of glp-1) FAS (fatty acid synthase) inhibitors (such as Cerulenin and C75), fat resorption inhibitors (such as those in WO03/053451, and the like), fatty acid transporter inhibitors, natural water soluble fibers (such as psyllium, plantago, guar, oat, pectin), galanin antagonists, galega (Goat's Rue, French Lilac), garcinia cambogia, germander (teucrium chamaedrys), ghrelin antibodies and ghrelin antagonists (such as those disclosed in WO01/87335, and WO02/08250), peptide hormones and variants thereof which affect the islet cell secretion, such as the hormones of the secretin/gastric inhibitory peptide (GIP)/vasoactive intestinal peptide (VIP)/pituitary adenylate cyclase activating peptide (PACAP)/glucagon-like peptide II (GLP-II)/glicentin/glucagon gene family and/or those of the adrenomedullin/amylin/calcitonin gene related peptide (CGRP) gene family includingGLP-1 (glucagon-like peptide 1) agonists (e.g. (1) exendin-4, (2) those GLP-1 molecules described in US20050130891 including GLP-1(7-34), GLP-1(7-35), GLP-1(7-36) or GLP-1(7-37) in its C-terminally carboxylated or amidated form or as modified GLP-1 peptides and modifications thereof including those described in paragraphs 17-44 of US20050130891, and derivatives derived from GLP-1-(7-34)COOH and the corresponding acid amide are employed which have the following general formula:

R-NH-HAEGTFTSDVSYLEGQAAKEFIAWLVK-
CONH2 (SEQ ID NO: 32)

wherein R=H or an organic compound having from 1 to 10 carbon atoms. Preferably, R is the residue of a carboxylic acid. Particularly preferred are the following carboxylic acid residues: formyl, acetyl, propionyl, isopropionyl, methyl, ethyl, propyl, isopropyl, n-butyl, sec-butyl, tert-butyl.) and glp-1 (glucagon-like peptide-1), glucocorticoid antagonists, glucose transporter inhibitors, growth hormone secretagogues (such as those disclosed and specifically described in U.S. Pat. No. 5,536,716), interleukin-6 (IL-6) and modulators thereof (as in WO03/057237, and the like), L-carnitine, Mc3r (melanocortin 3 receptor) agonists, MCH2R (melanin concentrating hormone 2R) agonist/antagonists, melanin concentrating hormone antagonists, melanocortin agonists (such as Melanotan II or those described in WO 99/64002 and WO 00/74679), nomame herba, phosphate transporter inhibitors, phytopharm compound 57 (CP 644,673), pyruvate, SCD-1 (stearoyl-CoA desaturase-1) inhibitors, T71 (Tularik, Inc., Boulder Colo.), Topiramate (Topimax®, indicated as an anticonvulsant which has been shown to increase weight loss), transcription factor modulators (such as those disclosed in WO03/026576), β-hydroxy steroid dehydrogenase-1 inhibitors (β-HSD-1), β-hydroxy-β-methylbutyrate, p57 (Pfizer), Zonisamide (Zonegran™, indicated as an anti-epileptic which has been shown to lead to weight loss), and the agents disclosed in US20030119428 paragraphs 20-26.

The peptides and agonists described herein can be used in therapeutic combination with one or more anti-diabetic agents, including but not limited to: PPARγ agonists such as glitazones (e.g., WAY-120,744, AD 5075, balaglitazone, ciglitazone, darglitazone (CP-86325, Pfizer), englitazone (CP-68722, Pfizer), isaglitazone (MIT/J&J), MCC-555 (Mitsibishi disclosed in U.S. Pat. No. 5,594,016), pioglitazone (such as such as Actos™ pioglitazone; Takeda), rosiglitazone (Avandia™; Smith Kline Beecham), rosiglitazone maleate, troglitazone (Rezulin®, disclosed in U.S. Pat. No. 4,572,912), rivoglitazone (CS-011, Sankyo), GL-262570 (Glaxo Welcome), BRL49653 (disclosed in WO98/05331), CLX-0921, 5-BTZD, GW-0207, LG-100641, JJT-501 (JPNT/P&U), L-895645 (Merck), R-119702 (Sankyo/Pfizer), NN-2344 (Dr. Reddy/NN), YM-440 (Yamanouchi), LY-300512, LY-519818, R483 (Roche), T131 (Tularik), and the like and compounds disclosed in U.S. Pat. No. 4,687,777, U.S. Pat. No. 5,002,953, U.S. Pat. No. 5,741,803, U.S. Pat. No. 5,965,584, U.S. Pat. No. 6,150,383, U.S. Pat. No. 6,150,384, U.S. Pat. No. 6,166,042, U.S. Pat. No. 6,166,043, U.S. Pat. No. 6,172,090, U.S. Pat. No. 6,211,205, U.S. Pat. No. 6,271,243, U.S. Pat. No. 6,288,095, U.S. Pat. No. 6,303,640, U.S. Pat. No. 6,329,404, U.S. Pat. No. 5,994,554, WO97/10813, WO97/27857, WO97/28115, WO97/28137, WO97/27847, WO00/76488, WO03/000685, WO03/027112, WO03/035602, WO03/048130, WO03/055867, and pharmaceutically acceptable salts thereof;

biguanides such as metformin hydrochloride (N,N-dimethylimidodicarbonimidic diamide hydrochloride, such as Glucophage™, Bristol-Myers Squibb); metformin hydrochloride with glyburide, such as Glucovance™, Bristol-Myers Squibb); buformin (Imidodicarbonimidic diamide, N-butyl-); etoformine (1-Butyl-2-ethylbiguanide, Schering A. G.); other metformin salt forms (including where the salt is chosen from the group of, acetate, benzoate, citrate, ftimarate, embonate, chlorophenoxyacetate, glycolate, palmoate, aspartate, methanesulphonate, maleate, parachlorophenoxy-isobutyrate, formate, lactate, succinate, sulphate, tartrate, cyclohexanecarboxylate, hexanoate, octanoate, decanoate, hexadecanoate, octodecanoate, benzenesulphonate, trimethoxybenzoate, paratoluenesulphonate, adamantanecarboxylate, glycoxylate, glutamate, pyrrolidonecarboxylate, naphthalenesulphonate, 1-glucosephosphate, nitrate, sulphite, dithionate and phosphate), and phenformin; protein tyrosine phosphatase-1B (PTP-1B) inhibitors, such as A-401, 674, KR 61639, OC-060062, OC-83839, OC-297962, MC52445, MC52453, ISIS113715, and those disclosed in WO99/585521, WO99/58518, WO99/58522, WO99/61435, WO03/032916, WO03/032982, WO03/041729, WO03/055883, WO02/26707, WO02/26743, JP2002114768, and pharmaceutically acceptable salts and esters thereof; sulfonylureas such as acetohexamide (e.g. Dymelor, Eli Lilly), carbutamide, chlorpropamide (e.g. Diabinese®, Pfizer), gliamilide (Pfizer), gliclazide (e.g. Diamcron, Servier Canada Inc), glimepiride (e.g. disclosed in U.S. Pat. No. 4,379,785, such as Amaryl™, Aventis), glipentide, glipizide (e.g. Glucotrol or Glucotrol XL Extended Release, Pfizer), gliquidone, glisolamide, glyburide/glibenclamide (e.g. Micronase or Glynase Prestab, Pharmacia & Upjohn and Diabeta, Aventis), tolazamide (e.g. Tolinase), and tolbutamide (e.g. Orinase), and pharmaceutically acceptable salts and esters thereof; meglitinides such as repaglinide (e.g. Pranidin®, Novo Nordisk), KAD1229 (PF/Kissei), and nateglinide (e.g. Starlix®, Novartis), and pharmaceutically acceptable salts and esters thereof;

α glucoside hydrolase inhibitors (or glucoside inhibitors) such as acarbose (e.g. Precose™, Bayer disclosed in U.S. Pat. No. 4,904,769), miglitol (such as GLYSEYF™, Pharmacia & Upjohn disclosed in U.S. Pat. No. 4,639,436), camiglibose (Methyl 6-deoxy-6-[(2R,3R,4R,5S)-3,4,5-trihydroxy-2-(hydroxymethyl)piperidino]-alpha-D-glucopyranoside, Marion Merrell Dow), voglibose (Takeda), adiposine, emiglitate, pradimicin-Q, salbostatin, CKD-711, MDL-25,637, MDL-73,945, and MOR 14, and the compounds disclosed in U.S. Pat. No. 4,062,950, U.S. Pat. No. 4,174,439, U.S. Pat. No. 4,254,256, U.S. Pat. No. 4,701,559, U.S. Pat. No. 4,639,436, U.S. Pat. No. 5,192,772, U.S. Pat. No. 4,634,765, U.S. Pat. No. 5,157,116, U.S. Pat. No. 5,504,078, U.S. Pat. No. 5,091,418, U.S. Pat. No. 5,217,877, US51091 and WO01/47528 (polyamines);

α-amylase inhibitors such as tendamistat, trestatin, and A1-3688, and the compounds disclosed in U.S. Pat. No. 4,451,455, U.S. Pat. No. 4,623,714, and U.S. Pat. No. 4,273,765;

SGLT2 inhibtors including those disclosed in U.S. Pat. No. 6,414,126 and U.S. Pat. No. 6,515,117;

an aP2 inhibitor such as disclosed in U.S. Pat. No. 6,548,529; insulin secreatagogues such as linogliride, A-4166, forskilin, dibutyrl cAMP, isobutylmethylxanthine (IBMX), and pharmaceutically acceptable salts and esters thereof;

fatty acid oxidation inhibitors, such as clomoxir, and etomoxir, and pharmaceutically acceptable salts and esters thereof;

A2 antagonists, such as midaglizole, isaglidole, deriglidole, idazoxan, earoxan, and fluparoxan, and pharmaceutically acceptable salts and esters thereof;

insulin and related compounds (e.g. insulin mimetics) such as biota, LP-100, novarapid, insulin detemir, insulin lispro, insulin glargine, insulin zinc suspension (lente and ultralente), Lys-Pro insulin, GLP-1 (1-36) amide, GLP-1 (73-7) (insulintropin, disclosed in U.S. Pat. No. 5,614,492), LY-315902 (Lilly), GLP-1 (7-36)-NH2), AL-401 (AutoImmune), certain compositions as disclosed in U.S. Pat. No. 4,579,730, U.S. Pat. No. 4,849,405, U.S. Pat. No. 4,963,526, U.S. Pat. No. 5,642,868, U.S. Pat. No. 5,763,396, U.S. Pat. No. 5,824,638, U.S. Pat. No. 5,843,866, U.S. Pat. No. 6,153,632, U.S. Pat. No. 6,191,105, and WO 85/05029, and primate, rodent, or rabbit insulin including biologically active variants thereof including allelic variants, more preferably human insulin available in recombinant form (sources of human insulin include pharmaceutically acceptable and sterile formulations such as those available from Eli Lilly (Indianapolis, Ind. 46285) as Humulin™ (human insulin rDNA origin), also see the THE PHYSICIAN'S DESK REFERENCE, 55.sup.th Ed. (2001) Medical Economics, Thomson Healthcare (disclosing other suitable human insulins); non-thiazolidinediones such as JT-501 and farglitazar (GW-2570/GI-262579), and pharmaceutically acceptable salts and esters thereof;

PPARα/γ dual agonists such as AR-H039242 (Aztrazeneca), GW-409544 (Glaxo-Wellcome), BVT-142, CLX-0940, GW-1536, GW-1929, GW-2433, KRP-297 (Kyorin Merck; 5-[(2,4-Dioxo thiazolidinyl)methyl]methoxy-N-[[4-(trifluoromethyl)phenyl]methyl]benzamide), L-796449, LR-90, MK-0767 (Merck/Kyorin/Banyu), SB 219994, muraglitazar (BMS), tesaglitzar (Astrazeneca), reglitazar (JTT-501) and those disclosed in WO99/16758, WO99/19313, WO99/20614, WO99/38850, WO00/23415, WO00/23417, WO00/23445, WO00/50414, WO01/00579, WO01/79150, WO02/062799, WO03/004458, WO03/016265, WO03/018010, WO03/033481, WO03/033450, WO03/033453, WO03/043985, WO 031053976, U.S. application Ser. No. 09/664,598, filed Sep. 18, 2000, Murakami et al. Diabetes 47, 1841-1847 (1998), and pharmaceutically acceptable salts and esters thereof;

other insulin sensitizing drugs;

VPAC2 receptor agonists;

GLK modulators, such as those disclosed in WO03/015774; retinoid modulators such as those disclosed in WO03/000249;

GSK 313/GSK 3 inhibitors such as 4-[2-(2-bromophenyl)-4-(4-fluorophenyl-1H-imidazol-5-yl]pyridine and those compounds disclosed in WO03/024447, WO03/037869, WO03/037877, WO03/037891, WO03/068773, EP1295884, EP1295885, and the like;

glycogen phosphorylase (HGLPa) inhibitors such as CP-368,296, CP-316,819, BAYR3401, and compounds disclosed in WO01/94300, WO02/20530, WO03/037864, and pharmaceutically acceptable salts or esters thereof; ATP consumption promotors such as those disclosed in WO03/007990;

TRB3 inhibitors;

vanilloid receptor ligands such as those disclosed in WO03/049702;

hypoglycemic agents such as those disclosed in WO03/015781 and WO03/040114;

glycogen synthase kinase 3 inhibitors such as those disclosed in WO03/035663 agents such as those disclosed in WO99/51225, US20030134890, WO01/24786, and WO03/059870; insulin-responsive DNA binding protein-1 (IRDBP-1) as disclosed in WO03/057827, and the like;

adenosine A2 antagonists such as those disclosed in WO03/035639, WO03/035640, and the like;

PPARδ agonists such as GW 501516, GW 590735, and compounds disclosed in JP10237049 and WO02/14291;

dipeptidyl peptidase IV (DP-IV) inhibitors, such as isoleucine thiazolidide, NVP-DPP728A (1-[[[2-[(5-cyanopyridin-2-yl)amino]ethyl]amino]acetyl]-2-cyano-(S)-pyrrolidine, disclosed by Hughes et al, Biochemistry, 38(36), 11597-11603, 1999), P32/98, NVP-LAF-237, P3298, TSL225 (tryptophyl-1,2,3,4-tetrahydro-isoquinoline-3-carboxylic acid, disclosed by Yamada et al, Bioorg. & Med. Chem. Lett. 8 (1998) 1537-1540), valine pyrrolidide, TMC-2A/2B/2C, CD-26 inhibitors, FE999011, P3310/$K_{364}$, VIP 0177, DPP4, SDZ 274-444, 2-cyanopyrrolidides and 4-cyanopyrrolidides as disclosed by Ashworth et al, Bioorg. & Med. Chem. Lett., Vol. 6, No. 22, pp 1163-1166 and 2745-2748 (1996), and the compounds disclosed in U.S. Pat. No. 6,395,767, U.S. Pat. No. 6,573,287, U.S. Pat. No. 6,395,767 (compounds disclosed include BMS-477118, BMS-471211 and BMS 538, 305), WO99/38501, WO99/46272, WO99/67279, WO99/67278, WO99/61431 WO03/004496, WO03/004426, EP1258476, WO02/083128, WO02/062764, WO03/000250, WO03/002530, WO03/002531, WO03/002553, WO03/002593, WO03/000180, and WO03/000181;
GLP-1 agonists such as exendin-3 and exendin-4 (including the 39 aa peptide synthetic exendin-4 called Exenatide®), and compounds disclosed in US2003087821 and NZ 504256, and pharmaceutically acceptable salts and esters thereof;
peptides including amlintide and Symlin® (pramlintide acetate); and
glycokinase activators such as those disclosed in US2002103199 (fused heteroaromatic compounds) and WO02/48106 (isoindolin-1-one-substituted propionamide compounds).

The peptides and agonists described herein useful in the treatment of obesity can be administered as a cotherapy with electrostimulation (US20040015201).

The peptides and agonists described herein can be used in combination therapy with agents that activate soluble guanylate cyclase, for example those described in US20040192680.

The peptides and agonists described herein can be used in combination therapy with a phosphodiesterase inhibitor. PDE inhibitors are those compounds which slow the degradation of cyclic AMP (cAMP) and/or cyclic GMP (cGMP) by inhibition of the phosphodiesterases, which can lead to a relative increase in the intracellular concentration of cAMP and/or cGMP. Possible PDE inhibitors are primarily those substances which are to be numbered among the class consisting of the PDE3 inhibitors, the class consisting of the PDE4 inhibitors and/or the class consisting of the PDE5 inhibitors, in particular those substances which can be designated as mixed types of PDE3/4 inhibitors or as mixed types of PDE3/4/5 inhibitors. By way of example, those PDE inhibitors may be mentioned such as are described and/or claimed in the following patent applications and patents: DE1470341, DE2108438, DE2123328, DE2305339, DE2305575, DE2315801, DE2402908, DE2413935, DE2451417, DE2459090, DE2646469, DE2727481, DE2825048, DE2837161, DE2845220, DE2847621, DE2934747, DE3021792, DE3038166, DE3044568, EP000718, EP0008408, EP0010759, EP0059948, EP0075436, EP0096517, EP0112987, EP0116948, EP0150937, EP0158380, EP0161632, EP0161918, EP0167121, EP0199127, EP0220044, EP0247725, EP0258191, EP0272910, EP0272914, EP0294647, EP0300726, EP0335386, EP0357788, EP0389282, EP0406958, EP0426180, EP0428302, EP0435811, EP0470805, EP0482208, EP0490823, EP0506194, EP0511865, EP0527117, EP0626939, EP0664289, EP0671389, EP0685474, EP0685475, EP0685479, JP92234389, JP94329652, JP95010875, U.S. Pat. Nos. 4,963,561, 5,141,931, WO9117991, WO9200968, WO9212961, WO9307146, WO9315044, WO9315045, WO9318024, WO9319068, WO9319720, WO9319747, WO9319749, WO9319751, WO9325517, WO9402465, WO9406423, WO9412461, WO9420455, WO9422852, WO9425437, WO9427947, WO9500516, WO9501980, WO9503794, WO9504045, WO9504046, WO9505386, WO9508534, WO9509623, WO9509624, WO9509627, WO9509836, WO9514667, WO9514680, WO9514681, WO9517392, WO9517399, WO9519362, WO9522520, WO9524381, WO9527692, WO9528926, WO9535281, WO9535282, WO9600218, WO9601825, WO9602541, WO9611917, DE3142982, DE1116676, DE2162096, EP0293063, EP0463756, EP0482208, EP0579496, EP0667345 U.S. Pat. No. 6,331, 543, US20050004222 (including those disclosed in formulas I-XIII and paragraphs 37-39, 85-0545 and 557-577) and WO9307124, EP0163965, EP0393500, EP0510562, EP0553174, WO9501338 and WO9603399. PDE5 inhibitors which may be mentioned by way of example are RX-RA-69, SCH-51866, KT-734, vesnarinone, zaprinast, SKF-96231, ER-21355, BF/GP-385, NM-702 and sildenafil (Viagra®). PDE4 inhibitors which may be mentioned by way of example are RO-20-1724, MEM 1414 (R1533/R1500; Pharmacia Roche), DENBUFYLLINE, ROLIPRAM, OXAGRELATE, NITRAQUAZONE, Y-590, DH-6471, SKF-94120, MOTAPIZONE, LIXAZINONE, INDOLIDAN, OLPRINONE, ATIZORAM, KS-506-G, DIPAMFYLLINE, BMY-43351, ATIZORAM, AROFYLLINE, FILAMINAST, PDB-093, UCB-29646, CDP-840, SKF-107806, PICLAMILAST, RS-17597, RS-25344-000, SB-207499, TIBENELAST, SB-210667, SB-211572, SB-211600, SB-212066, SB-212179, GW-3600, CDP-840, MOPIDAMOL, ANAGRELIDE, IBUDILAST, AMRINONE, PIMOBENDAN, CILOSTAZOL, QUAZINONE and N-(3,5-dichloropyrid-4-yl)-3-cyclopropylmethoxy-4-difluoromethoxybenzamide. PDE3 inhibitors which may be mentioned by way of example are SULMAZOLE, AMPIZONE, CILOSTAMIDE, CARBAZERAN, PIROXIMONE, IMAZODAN, CI-930, SIGUAZODAN, ADIBENDAN, SATERINONE, SKF-95654, SDZ-MKS-492, 349-U-85, EMORADAN, EMD-53998, EMD-57033, NSP-306, NSP-307, REVIZINONE, NM-702, WIN-62582 and WIN-63291, ENOXIMONE and MILRINONE. PDE3/4 inhibitors which may be mentioned by way of example are BENAFENTRINE, TREQUINSIN, ORG-30029, ZARDAVERINE, L-686398, SDZ-ISQ-844, ORG-20241, EMD-54622, and TOLAFENTRINE. Other PDE inhibitors include: cilomilast, pentoxifylline, roflumilast, tadalafil(Clalis®), theophylline, and vardenafil(Levitra®), zaprinast (PDE5 specific).

The peptides and agonists described herein can be used in combination therapy (for example, in order to decrease or inhibit uterine contractions) with a tocolytic agent including but not limited to beta-adrenergic agents, magnesium sulfate, prostaglandin inhibitors, and calcium channel blockers.

The peptides and agonists described herein can be used in combination therapy with an anti-neoplastic agents including but not limited to alkylating agents, epipodophyllotoxins, nitrosoureas, antimetabolites, vinca alkaloids, anthracycline antibiotics, nitrogen mustard agents, and the like. Particular anti-neoplastic agents may include tamoxifen, taxol, etoposide and 5-fluorouracil. The peptides and agonists described herein can be used in combination therapy (for example as in a chemotherapeutic composition) with an antiviral and monoclonal antibody therapies.

The peptides and agonists described herein can be used in combination therapy (for example, in prevention/treatment of congestive heart failure or another method described herein) with the partial agonist of the nociceptin receptor ORL1 described by Dooley et al. (The Journal of Pharmacology and Experimental Therapeutics, 283 (2): 735-741, 1997). The agonist is a hexapeptide having the amino acid sequence Ac-RYY (RK) (WI) (RK)-NH2 ("the Dooley peptide"), where the brackets show allowable variation of amino acid residue. Thus Dooley peptide can include but are not limited to KYYRWR (SEQ ID NO:42), RYYRWR (SEQ ID NO:43), KWRYYR (SEQ ID NO:44), RYYRWK (SEQ ID NO:45), RYYRWK (all-D amino acids) (SEQ ID NO:46), RYYRIK (SEQ ID NO:47), RYYRIR (SEQ ID NO:48), RYYKIK (SEQ ID NO:49), RYYKIR (SEQ ID NO:50), RYYKWR (SEQ ID NO:51), RYYKWK (SEQ ID NO:52), RYYRWR (SEQ ID NO:53), RYYRWK (SEQ ID NO:54), RYYRIK (SEQ ID NO:55), RYYKWR (SEQ ID NO:56), RYYKWK (SEQ ID NO:57), RYYRK(SEQ ID NO:58) and KYYRWK (SEQ ID NO:59), wherein the amino acid residues are in the L-form unless otherwise specified. The peptides and agonists described herein can also be used in combination therapy with peptide conjugate modifications of the Dooley peptide described in WO0198324.

Methods of Treatment

A number of disorders might be prevented or treated with GC-C receptor agonists and agents that increase cGMP levels including the peptides and agonists described herein.

The peptides and agonists described herein can be used alone or in combination therapy for the treatment or prevention of congestive heart failure. Such agents can be used in combination with natriuretic peptides (e.g., atrial natriuretic peptide, brain natriuretic peptide or C-type natriuretic peptide), a diuretic, or an inhibitor of angiotensin converting enzyme.

The peptides and agonists described herein can be used alone or in combination therapy for the treatment or prevention of benign prostatic hyperplasia (BPH). Such agents can be used in combination with one or more agents for treatment of BPH, for example, a 5-alpha reductase inhibitor (e.g., finasteride) or an alpha adrenergic inhibitor (e.g., doxazosine).

The peptides and agonists described herein can be used alone or in combination therapy for the treatment, prevention or reduction of visceral pain associated with a gastrointestinal disorder or pain associated with another disorder.

The peptides and agonists described herein can be used alone or in combination therapy for the treatment or prevention of obesity-related disorders (e.g. disorders that are associated with, caused by, or result from obesity). Examples of obesity-related disorders include overeating and bulimia, hypertension, diabetes, elevated plasma insulin concentrations and insulin resistance, dyslipidemias, hyperlipidemia, endometrial, breast, prostate and colon cancer, osteoarthritis, obstructive sleep apnea, cholelithiasis, gallstones, heart disease, abnormal heart rhythms and arrhythmias, myocardial infarction, congestive heart failure, coronary heart disease, sudden death, stroke, polycystic ovarian disease, craniopharyngioma, the Prader-Willi Syndrome, Frohlich's syndrome, GH-deficient subjects, normal variant short stature, Turner's syndrome, and other pathological conditions showing reduced metabolic activity or a decrease in resting energy expenditure as a percentage of total fat-free mass, e.g., children with acute lymphoblastic leukemia. The agents described herein may be used to reduce or control body weight (or fat) or to prevent and/or treat obesity or other appetite related disorders related to the excess consumption of food, ethanol and other appetizing substances. The agents may be used to modulate lipid metabolism, reduce body fat (e.g. via increasing fat utilization) or reduce (or suppress) appetite (e.g. via inducing satiety). Further examples of obesity-related disorders are metabolic syndrome, also known as syndrome X, insulin resistance syndrome, sexual and reproductive dysfunction, such as infertility, hypogonadism in males and hirsutism in females, gastrointestinal motility disorders, such as obesity-related gastroesophageal reflux, respiratory disorders, such as obesity-hypoventilation syndrome (Pickwickian syndrome), cardiovascular disorders, inflammation, such as systemic inflammation of the vasculature, arteriosclerosis, hypercholesterolemia, hyperuricaemia, lower back pain, gallbladder disease, gout, and kidney cancer. The agents of the present disclosure are also useful for reducing the risk of secondary outcomes of obesity, such as reducing the risk of left ventricular hypertrophy.

The peptides and agonists described herein can be used alone or in combination therapy for the treatment or prevention of gastrointestinal related disorders including: chronic intestinal pseudo-obstruction (Ogilvie's syndrome), colonic pseudoobstruction, Crohn's disease, dyspepsia (including functional dyspepsia or nonulcer dyspepsia), duodenogastric reflux, functional bowel disorder, functional gastrointestinal disorders, functional heartburn, gastroesophageal reflux disease (GERD), gastrointestinal motility disorders, gastroparesis (e.g. idopathic gastroparesis), hypertrophic pyloric stenosis, Inflammatory bowel disease, irritable bowel syndrome (IBS), post-operative ileus, and ulcerative colitis. The peptides and agonists described herein can be used alone or in combination therapy to patient suffering from or susceptible to GI disorders relating to damage to the GI tract stemming from impact or surgical intervention. The peptides and agonists described herein can be used alone or in combination therapy to patients at risk for or having particular diseases associated with hypomotility (e.g. colonic inertia) or stasis in the GI tract. For example, diabetic neuropathy, anorexia nervosa, and achlorhydria are frequently accompanied by gastric hypomotility. Damage to the GI tract following surgical intervention, for instance, can result in substantial gastric stasis. The peptides and agonists described herein can be administered alone or in combination therapy to patients susceptible to or having a GI disorder associated with diabetes (e.g. diabetic gastropathy). The peptides and agonists described herein can be used alone or in combination therapy to prevent and/or treat GI disorders characterized by at least one of nausea, vomiting, heartburn, postprandial discomfort, diarrhea, constipation, indigestion or related symptoms. The peptides and agonists described herein can be used alone or in combination therapy to prevent and/or treat GI disorders associated with at least one of diabetes, anorexia nervosa, bulimia, achlorhydria, achalasia, anal fissure, haemorrhoids, irritable bowel syndrome, intestinal pseudoobstruction, scleroderma and gastrointestinal damage.

The peptides and agonists described herein can be used to prevent and/or treat constipation. Constipation can be used to describe bowel patterns which include one or more of hard, small, infrequent stools; the sensation of difficulty in passing stool, specifically excessive or ineffectual straining; the sensation of incomplete evacuation. Constipation has also been described as the passage of stool less than a certain number (e.g. 3) of times per week. A number of conditions can be associated with constipation. Constipation can be associated with numerous disorders and conditions. For example, constipation can be (1) associated with the use of a therapeutic agent (e.g. antihypertensives, anticonvulsants, antispasmodics, analgesics, anticholinergics, antidepressants, antipsychotics, cation-containing agents, anticonvulsants, ganglion blockers, vinca alkaloids); (2) associated with a muscular, neuropathic, metabolic or endocrine disorder (including but not limited to myotonic dystrophy, dermamyositis, systemic sclerosis, sclerodoma, amyloidosis (neurologic or muscular), ischemia, tumor of the central nervous system, autonomic neuropathy, Chagas disease, cystic fibrosis, diabetes mellitus, Hirschsprung disease, hyperthyroidism, hypocalcaemia, hypothyroidism, Multiple Sclerosis, neurofibromatosis, Parkinson's disease, and spinal cord lesions (for example, related to sacral nerve damage related to trauma or a tumor or the enteric nervous system)); (3) post-surgical constipation (postoperative ileus); (4) associated with a structural colon alteration (for example that associated with Neoplasm, stricture, volvulus, anorectal, inflammation, prolapse, rectocele, or fissure); (5) associated with the a gastrointestinal disorder; (6) associated with a systemic illness or disorder (for example, electrolyte abnormalities, thyroid disease, diabetes mellitus, panhypopituitarism, Addison's disease, pheochromocytoma, uremia, porphyria); (7) chronic constipation; (8) associated with the use of analgesic drugs (e.g. opioid induced constipation); (9) associated with megacolon; and (10) idiopathic constipation (functional constipation). Functional constipation can be associated with normal transit, slow transit (e.g. one or fewer bowel movements per week) and pelvic floor dyssynergia. Pelvic floor dyssynergia is considered a disorder of the rectum and anus although these patients also have abnormal contractions throughout the colon. Patients with pelvic floor dyssynergia have abnormal colonic pressure waves prior to defecation and present with symptoms that may include a sensation of incomplete evacuation, excessive straining, a need for digital disimpaction, perianal heaviness, and tenesmus. Constipation can be associated with bloating and abdominal pain. The peptides and agonists described herein can be used to prevent and/or treat low stool frequency or poor stool consistency.

The peptides and agonists described herein can be used to treat decreased intestinal motility, slow digestion or slow stomach emptying. The peptides and agonists can be used to relieve one or more symptoms of IBS (bloating, pain, constipation), GERD (acid reflux into the esophagus), duodenogastric reflux, functional dyspepsia, or gastroparesis (nausea, vomiting, bloating, delayed gastric emptying) and other disorders described herein. The peptides and agonists described herein can be used to treat flatulence.

The peptides and agonists described herein can be used to increase intestinal motility, slow colonic transit, and to prevent and/or treat gastrointestinal immotility and other conditions calling for laxative or stool softener therapy. Gastrointestinal immotility can include constipation, and also includes delayed oral cecal transit time, irregular Taxation, and other related gastrointestinal motility disfunction including impaction. Impaction is a condition where a large mass of dry, hard stool develops in the rectum, often due to chronic constipation. This mass may be so hard that it cannot be excreted. The subjects affected by constipation or gastrointestinal immotility can be refractory to laxative therapy and/or stool softener therapy.

The peptides and agonists described herein can be used for the treatment or prevention of cancer, pre-cancerous growths, or metastatic growths. For example, they can be used for the prevention or treatment of: colorectal/local metastasized colorectal cancer, intestinal polyps, gastrointestinal tract cancer, lung cancer, cancer or pre-cancerous growths or metastatic growths of epithelial cells, polyps, breast, colorectal, lung, ovarian, pancreatic, prostatic, renal, stomach, bladder, liver, esophageal and testicular carcinoma, carcinoma (e.g., basal cell, basosquamous, Brown-Pearce, ductal carcinoma, Ehrlich tumor, Krebs, Merkel cell, small or non-small cell lung, oat cell, papillary, bronchiolar, squamous cell, transitional cell, (Walker), leukemia (e.g., B-cell, T-cell, HTLV, acute or chronic lymphocytic, mast cell, myeloid), histiocytonia, histiocytosis, Hodgkin's disease, non-Hodgkin's lymphoma, plasmacytoma, reticuloendotheliosis, adenoma, adeno-carcinoma, adenofibroma, adenolymphoma, ameloblastoma, angiokeratoma, angiolymphoid hyperplasia with eosinophilia, sclerosing angioma, angiomatosis, apudoma, branchionia, malignant carcinoid syndrome, carcinoid heart disease, carcinosarcoma, cementoma, cholangioma, cholesteatoma, chondrosarcoma, chondroblastoma, chondrosarcoma, chordoma, choristoma, craniopharyngioma, chrondrorna, cylindroma, cystadenocarcinoma, cystadenoma, cystosarconia phyllodes, dysgenninoma, ependymoma, Ewing sarcoma, fibroma, fibrosarcoma, giant cell tumor, ganglioneuroma, glioblastoma, glomangioma, granulosa cell tumor, gynandroblastoma, hamartoma, hemangioendothelioma, hemangioma, hemangio-pericytoma, hemangiosarcoma, hepatoma, islet cell tumor, Kaposi sarcoma, leiomyoma, leiomyosarcoma, leukosarcoma, to Leydig cell tumor, lipoma, liposarcoma, lymphaugioma, lymphangiomyoma, lymphangiosarcoma, medulloblastoma, meningioma, mesenchymoma, mesonephroma, mesothelioma, myoblastoma, myoma, myosarcoma, myxoma, myxosarcoma, neurilemmoma, neuroma, neuroblastoma, neuroepithelioma, neurofibroma, neurofibromatosis, odontoma, osteoma, osteosarcoma, papilloma, paraganglioma, paraganglionia. nonchromaffin, pinealoma, rhabdomyoma, rhabdomyosarcoma, Sertoli cell tumor, teratoma, theca cell tumor, and other diseases in which cells have become dysplastic, immortalized, or transformed.

The peptides and agonists described herein can be used for the treatment or prevention of: Familial Adenomatous Polyposis (FAP) (autosomal dominant syndrome) that precedes colon cancer, hereditary nonpolyposis colorectal cancer (HNPCC), and inherited autosomal dominant syndrome.

For treatment or prevention of cancer, pre-cancerous growths and metastatic growths, the peptides and agonists described herein can be used in combination therapy with radiation or chemotherapeutic agents, an inhibitor of a cGMP-dependent phosphodiesterase or a selective cyclooxygenase-2 inhibitor. A number of selective cyclooxygenase-2 inhibitors are described in US20010024664, U.S. Pat. No. 5,380,738, U.S. Pat. No. 5,344,991, U.S. Pat. No. 5,393,790, U.S. Pat. No. 5,434,178, U.S. Pat. No. 5,474,995, U.S. Pat. No. 5,510,368, WO02/062369, WO 96/06840, WO 96/03388, WO 96/03387, WO 96/19469, WO 96/25405, WO 95/15316, WO 94/15932, WO 94/27980, WO 95/00501, WO 94/13635, WO 94/20480, and WO 94/26731, the disclosures of which are herein incorporated by reference. [Pyrazol-1-yl] benzenesulfonamides have also been described as inhibitors of cyclooxygenase-2.

The peptides and agonists described herein can be used in the treatment or prevention of inflammation. Thus, they can be used alone or in combination with an inhibitor of cGMP-dependent phosphodiesterase or a selective cyclooxygenase-2 inhibitor for treatment of: organ inflammation, IBD (e.g, Crohn's disease, ulcerative colitis), asthma, nephritis, hepatitis, pancreatitis, bronchitis, cystic fibrosis, ischemic bowel diseases, intestinal inflammations/allergies, coeliac disease, proctitis, eosinophilic gastroenteritis, mastocytosis, and other inflammatory disorders. The peptides and agonists described herein can be used alone or in combination therapy in the treatment or prevention of gastrointestinal tract inflammation (e.g. inflammation associated with a gastrointestinal disorder, gastrointestinal tract infection, or another disorder). They can be used alone or in combination therapy with phenoxyalkycarboxylic acid derivatives for the treatment of interstitial cystitis, irritable bowel syndrome, ulcerative colitis, and other inflammatory conditions, as mentioned in US20050239902A1.

The peptides and agonists described herein can also be used to treat or prevent insulin-related disorders, for example: II diabetes mellitus, hyperglycemia, obesity, disorders associated with disturbances in glucose or electrolyte transport and insulin secretion in cells, or endocrine disorders. They can be also used in insulin resistance treatment and post-surgical and non-post surgery decrease in insulin responsiveness.

The peptides and agonists described herein can be used to prevent and/or treat pulmonary and respiratory related disorders, including, inhalation, ventilation and mucus secretion disorders, pulmonary hypertension, chronic obstruction of vessels and airways, acute respiratory failure, and irreversible obstructions of vessels and bronchi. One may administer an agent described herein for treating bronchospasm, for inducing bronchodilation, for treating chronic obstructive pulmonary disease (including chronic bronchitis with normal airflow), for treating asthma (including bronchial asthma, intrinsic asthma, extrinsic asthma, acute asthma, chronic or inveterate asthma (e.g. late asthma and airways hyper-responsiveness), dust-induced asthma, allergen-induced asthma, viral-induced asthma, cold-induced asthma, pollution-induced asthma and exercise-induced asthma) and for treating rhinitis (including acute-, allergic, hatrophic rhinitis or chronic rhinitis (such as rhinitis caseosa, hypertrophic rhinitis, rhinitis purulenta, rhinitis sicca), rhinitis medicamentosa, membranous rhinitis (including croupous, fibrinous and pseudomembranous rhinitis), scrofulous rhinitis, perennial allergic rhinitis, seasonal rhinitis (including rhinitis nervosa (hay fever) and vasomotor rhinitis). The peptides described herein may also be useful in the treatment of dry eye disease and chronic sinusitis. The peptides described herein may also be used to prevent and/or treat disorders characterized by acute pulmonary vasoconstriction such as may result from pneumonia, traumatic injury, aspiration or inhalation injury, fat embolism in the lung, acidosis inflammation of the lung, adult respiratory distress syndrome, acute pulmonary edema, acute mountain sickness, post-cardiac surgery, acute pulmonary hypertension, persistent pulmonary hypertension of the newborn, perinatal aspiration syndrome, hyaline membrane disease, acute pulmonary thromboembolism, herapin-protamine reactions, sepsis, status asthmaticus or hypoxia (including iatrogenic hypoxia) and other forms of reversible pulmonary vasoconstriction. Such pulmonary disorders also are also characterized by inflammation of the lung including those associated with the migration into the lung of nonresident cell types including the various leucocyte subclasses. Also included in the respiratory disorders contemplated are: bullous disease, cough, chronic cough associated with inflammation or iatrogenic induced, airway constriction, pigeon fancier's disease, eosinophilic bronchitis, asthmatic bronchitis, chronic bronchitis with airway obstruction (chronic obstructive bronchitis), eosinophilic lung disease, emphysema, farmer's lung, allergic eye diseases (including allergic conjunctivitis, vernal conjunctivitis, vernal keratoconjunctivitis, and giant papillary conjunctivitis), idiopathic pulmonary fibrosis, cystic fibrosis, diffuse pan bronchiolitis and other diseases which are characterized by inflammation of the lung and/or excess mucosal secretion. Other physiological events which are contemplated to be prevented, treated or controlled include platelet activation in the lung, chronic inflammatory diseases of the lung which result in interstitial fibrosis, such as interstitial lung diseases (ILD) (e.g., idiopathic pulmonary fibrosis, or ILD associated with rheumatoid arthritis, or other autoimmune conditions), chronic obstructive pulmonary disease (COPD) (such as irreversible COPD), chronic sinusitis, fibroid lung, hypersensitivity lung diseases, hypersensitivity pneumonitis, idiopathic interstitial pneumonia, nasal congestion, nasal polyposis, and otitis media.

The peptides and agonists described herein can be used alone or in combitherapy to prevent or treat: retinopathy, nephropathy, diabetic angiopathy, and edema formation The peptides and agonists described herein can be used alone or in combitherapy to prevent or treat neurological disorders, for example, headache, tension-type headache, migraines, anxiety, stress, cognitive disorders, cerebral ischemia, brain trauma, movement disorders, aggression, psychosis, seizures, panic attacks, hysteria, sleep disorders, depression, schizoaffective disorders, sleep apnea, attention deficit syndromes, memory loss, dementia, memory and learning disorders as discussed in Moncada and Higgs 1995 FASEB J. 9:1319-1330; Severina 1998 Biochemistry 63:794; Lee et al. 2000 PNAS 97: 10763-10768; Hobbs 1997 TIPS 18:484-491; Murad 1994 Adv. Pharmacol. 26:1-335; and Denninger et al. 1999 Biochim. Biophys. Acta 1411:334-350 and narcolepsy. They may also be used as a sedative.

The peptides and detectably peptides and agonists described herein can be used as markers to identify, detect, stage, or diagnosis diseases and conditions of small intestine, including, without limitation: Crohn's disease, colitis, inflammatory bowel disease, tumors, benign tumors, such as benign stromal tumors, adenoma, angioma, adenomatous (pedunculated and sessile) polyps, malignant, carcinoid tumors, endocrine cell tumors, lymphoma, adenocarcinoma, foregut, midgut, and hindgut carcinoma, gastroinstestinal stromal tumor (GIST), such as leiomyoma, cellular leiomyoma, leiomyoblastoma, and leiomyosarcoma, gastrointestinal autonomic nerve tumor, malabsorption syndromes, celiac diseases, diverticulosis, Meckel's diverticulum, colonic diverticula, megacolon, Hirschsprung's disease, irritable bowel syndrome, mesenteric ischemia, ischemic colitis, colorectal cancer, colonic polyposis, polyp syndrome, intestinal adenocarcinoma, Liddle syndrome, Brody myopathy, infantile convulsions, and choreoathetosis The peptides and agonists described herein can be conjugated to another molecule (e.g., a diagnostic or therapeutic molecule) to target cells bearing the GC-C receptor, e.g., cystic fibrosis lesions and specific cells lining the intestinal tract. Thus, they can be used to target radioactive moieties or therapeutic moieties (active moieties like a radionuclide, an enzyme, a fluorescent label, a metal chelating group, a chemiluminescent label, a bioluminescent label, a chemotherapeutic, a toxin, an inactive prodrug, a radiosensitizing agent, a photodynamic agent) to the intestine to aid in imaging and diagnosing or treating colorectal/metastasized or local colorectal cancer. In addition, they can be used to deliver antisense molecules or nucleic acid molecules (like normal copies of the p53 tumor suppressor gene) to the intestinal tract. The peptides and agonists described herein can also be used to increase the number of GC-C molecules on the surface of a cell. In some embodiments the cell is a metastasized colorectal cancer cell. In one embodiment the peptide or agonist described herein is therapeutically conjugated to a second agent. In certain embodiments, the second agent can be radioactive or radiostable. In certain embodiments the second agent can be selected from the group consisting of a compound that causes cell death, a compound that inhibits cell division, a compound that induces cell differentiation, a chemotherapeutic, a toxin and a radiosensitizing agent. In certain embodiments the second agent can be selected from the group consisting of: methotrexate, doxorubicin, daunorubicin, cytosinarabinoside, etoposide, 5-4 fluorouracil, melphalan, chlorambucil, cis-platin, vindesine, mitomycin, bleomycin, purothionin, macromomycin, 1,4-benzoquinone derivatives, trenimon, ricin, ricin A chain, *Pseudomonas* exotoxin, diphtheria toxin, *Clostridium perfringens* phospholipase C, bovine pancreatic ribonuclease, pokeweed antiviral protein, abrin, abrin A chain, cobra venom factor, gelonin, saporin, modeccin, viscumin, volkensin, nitroimidazole, metronidazole and misonidazole. In certain embodiments the second agent can be a cytoxic agent selected from the group consisting of cemadotin, a derivative of cemadotin, a derivative of hemiasterlin, esperamicin C, neocarzinostatin, maytansinoid DM1, 7-chloromethyl-10,11 methylenedioxy-camptothecin, rhizoxin, and the halichondrin B analog, ER-086526.

The peptides and agonists described herein can be used alone or in combination therapy to prevent and/or treat inner ear disorders, e.g., to prevent and/or treat Meniere's disease (including symptoms thereof such as vertigo, hearing loss, tinnitus, sensation of fullness in the ear), Mal de débarquement syndrome, otitis externa, otitis media, otorrhea, acute mastoiditis, otosclerosis, otic pain, otic bleeding, otic inflammation, Lermoyez's syndrome, vestibular neuronitis, benign paroxysmal positional vertigo (BPPV), herpes zoster oticus, Ramsay Hunt's syndrome, herpes, labyrinthitis, purulent labyrinthitis, perilymph fistulas, presbycusis, ototoxicity (including drug-induced ototoxicity), neuromias (including acoustic neuromas), aerotitis media, infectious myringitis, bullous myringitis, squamous cell carcinoma, basal cell carcinoma, pre-cancerous otic conditions, nonchromaffin paragangliomas, chemodectomas, glomus jugulare tumors, glomus tympanicum tumors, perichondritis, aural eczematoid dermatitis, malignant external otitis, subperichondrial hematoma, ceruminomas, impacted cerumen, sebaceous cysts, osteomas, keloids, otalgia, tinnitus, tympanic membrane infection, tympanitis, otic furuncles, petrositis, conductive and sensorineural hearing loss, epidural abscess, lateral sinus thrombosis, subdural empyema, otitic hydrocephalus, Dandy's syndrome, bullous myringitis, diffuse external otitis, foreign bodies, keratosis obturans, otic neoplasm, otomycosis, trauma, acute barotitis media, acute eustachian tube obstruction, postsurgical otalgia, cholesteatoma, infections related to an otic surgical procedure, and complications associated with any of said disorders. The peptides and agonists described herein can be used alone or in combination therapy to maintain fluid homeostasis in the inner ear. neuronitis (including viral neuronitis), ganglionitis, geniculate The peptides and agonists described herein can be used alone or in combination therapy to prevent and/or treat disorders associated with bicarbonate secretion, e.g., Cystic Fibrosis.

The peptides and agonists described herein can be used alone or in combination therapy to prevent and/or treat disorders associated with bile secretion. In addition, they can be used to facilitate or control chloride and bile fluid secretion in the gall bladder.

The peptides and agonists described herein can be used alone or in combination therapy to prevent and/or treat disorders associated with liver cell regeneration. This may include administration of the peptides and agonists to liver transplant recipients and to patients with drug or alcohol induced-liver damage. Furthermore, the peptides and agonists may be useful to treat liver damage as in the case of viral mediated hepatitis. The peptides and agonists described herein may be used alone or in combination to prevent and/or treat liver abscess, liver cancer (either primary or metastatic), cirrhosis (such as cirrhosis caused by the alcohol consumption or primary biliary cirrhosis), amebic liver abscess, autoimmune hepatitis, biliary atresia, coccidioidomycosis disseminated, δ agent (hepatitis δ), hemochromatosis, hepatitis a, hepatitis b, hepatitis c, or any other acute, subacute, fulminant or chronic hepatitis of viral, metabolic or toxic etiology, hepatocellular carcinoma, pyogenic liver abscess, Reye's syndrome, sclerosing cholangitis, Wilson's disease, drug induced hepatotoxicity, or fulminant or acute liver failure. The peptides and agonists may be used in stimulating hepatic regeneration after surgical hepatectomy. The peptides and agonists described herein can be used alone or in combination therapy to prevent and/or treat myocardial infraction, coronary artery disease, nitrate-induced tolerance, nitrate tolerance, diastolic dysfunction, angina pectoris, stable, unstable and variant (Prinzmetal) angina, atherosclerosis, thrombosis, endothelial dysfunction, cardiac edema, stroke, conditions of reduced blood vessel patency, e.g., postpercutaneous transluminal coronary angioplasty (post-PTCA), and peripheral vascular disease.

The peptides and agonists described herein can be used alone or in combination therapy to prevent and/or treat glaucoma.

The peptides and agonists described herein can be used alone or in combination therapy to prevent and/or treat immunodeficiency.

The peptides and agonists described herein can be used alone or in combination therapy to prevent and/or treat bladder outlet obstruction and incontinence.

The peptides and agonists described herein can be used alone or in combination therapy to prevent and/or treat male (e.g. erectile dysfunction) or female sexual dysfunction, dysmenorrhea, endometriosis, polycystic ovary syndrome, vaginal dryness, uterine pain, or pelvic pain. These peptides and agonists described herein can be utilized as tocolytic agents that decrease or arrest uterine contractions. The peptides and agonists described herein can be used to prevent/treat premature/preterm labor. Premature or preterm labor can be associated with, for example, an illness/disorder/condition of the mother (such as pre-eclampsia, high blood pressure or diabetes, abnormal shape or size of the uterus, weak or short cervix, hormone imbalance, vaginal infection that spreads to the uterus, abnormalities of the placenta, such as placenta previa, and excessive amniotic fluid), premature rupture of the amniotic membranes ("water breaks"), large fetus, and more than one fetus. The peptides or agonists described herein can be used to prevent uterine rupture. The peptides or agonists described herein can be used treat rapid uterine contractions (for example, associated with placental abruption wherein the placental abruption is associated with hypertension, diabetes, a multiply pregnancy, an unusually large amount of amniotic fluid, numerous previous deliveries, or advanced maternal age (e.g. >40 years old). In certain embodiments they can be used in combination with a phosphodiesterase inhibitor. The peptides and agonists described herein can be used alone or in combination therapy to prevent and/or treat infertility, for example, male infertility due to poor sperm quality, decreased sperm motility or low sperm count.

The peptides and agonists described herein can be used alone or in combination therapy to prevent and/or treat osteopenia disorders (bone loss disorders). "Bone loss disorders" include conditions and diseases wherein the inhibition of bone loss and/or the promotion of bone formation is desirable. Among such conditions and diseases are osteoporosis, osteomyelitis, Paget's disease (osteitis deformans), periodontitis, hypercalcemia, osteonecrosis, osteosarcoma, osteolyic metastases, familial expansile osteolysis, prosthetic loosening, periprostetic osteolysis, bone loss attendant rheumatoid arthritis, and cleiodocranial dysplasia (CCD). Osteoporosis includes primary osteoporosis, endocrine osteoporosis (hyperthyroidism, hyperparathyroidism, Cushing's syndrome, and acromegaly), hereditary and congenital forms of osteoporosis (osteogenesis imperfecta, homocystinuria, Menkes' syndrome, and Rile-Day syndrome) and osteoporosis due to immobilization of extremitiesosteomyelitis, or an infectious lesion in bone leading to bone loss. The peptides and agonists can be used alone or in combination therapy to stimulating bone regeneration. The bone regeneration may be following reconstruction of bone defects in cranio-maxillofacial surgery, or following an implant into bone, for example a dental implant, bone supporting implant, or prosthesis. The bone regeneration may also be following a bone fracture.

The peptides and agonists described herein may be used alone or in combination therapy (for example, with other agents that increase cGMP) to prevent or treat disorders related to an alteration in cGMP including, but not limited to Alzheimer's disease, psoriasis, skin necrosis, scarring, fibrosis, baldness, Kawasaki's Disease, nutcracker oesophagus (US20050245544), septic shock, NSAID-induced gastric disease or disorder, ischemic renal disease or disorder, peptic ulcer, sickle cell anemia, epilepsy, and a neuroinflammatory disease or disorder (for example as described in WO05105765). The peptides described herein can be used as immunogens to create antibodies for immunoassays. The peptides described herein that have homology to ST peptides can be used as immunogens to treat and/or prevent one or more disease symptoms associated with traveler's diarrhea and for vaccination against pathogens, including but not limited to enterotoxigenic E. coli (ETEC). They may also be used in vaccines which also comprise interleukin 18 and either saponin adjuvant or CpG adjuvant for example as described in WO05039634 and WO05039630. The methods described in US20040146534, U.S. Pat. No. 4,220,584, U.S. Pat. No. 4,285,391, U.S. Pat. No. 5,182,109, U.S. Pat. No. 4,603,049, U.S. Pat. No. 4,545,931, U.S. Pat. No. 4,886,663, U.S. Pat. No. 4,758,655, WO08402700, FR2525592, and FR2532850 can be similarly used to create immunogens comprising the peptides described herein. U.S. Pat. No. 6,043,057, U.S. Pat. No. 5,834,246, U.S. Pat. No. 5,268,276, and EP368819, specifically describe an expression system containing CTB (cholera toxin Beta subunit) fused to an ST-like peptide under a foreign promoter for use as a vaccine. The nucleic acids that encode the peptides described herein may be use as genetic vaccines as described in US20050260605 and WO0148018. The nucleic acid molecules may also be used for the manufacture of a functional ribonucleic acid, wherein the functional ribonucleic acid is selected from the group comprising ribozymes, antisense nucleic acids and siRNA (as described in WO05103073).

SEQUENCE LISTING (3511 sequences)

SEQ ID NO: 1 - protein, 14 aa, Artificial Sequence
  Synthetically generated peptide
  MISC_FEATURE (1)..(1): Xaa is D-Cys.
XCEYCCNPACTGCY

SEQ ID NO: 2 - protein, 14 aa, Artificial Sequence
  Synthetically generated peptide
CCEYCCNPACTGCK

SEQ ID NO: 3 - protein, 14 aa, Artificial Sequence
  Synthetically generated peptide
CCEFCCNPACTGCY

SEQ ID NO: 4 - protein, 14 aa, Artificial Sequence
  Synthetically generated peptide
CCEWCCNPACTGCY

SEQ ID NO: 5 - protein, 14 aa, Artificial Sequence
  Synthetically generated peptide
CCEYCCTPACTGCY

SEQ ID NO: 6 - protein, 14 aa, Artificial Sequence
  Synthetically generated peptide
CCELCCNPACTGCY

SEQ ID NO: 7 - protein, 16 aa, Artificial Sequence
  Synthetically generated peptide
  MISC_FEATURE (1)..(1): Xaa is any amino acid or is missing.
  MISC_FEATURE (2)..(2): Xaa is Ala, Gly, Lys, Ser, Val or is missing.
  MISC_FEATURE (3)..(3): Xaa is is Cys or D-Cys.
  MISC_FEATURE (6)..(6): Xaa is any amino acid.
  MISC_FEATURE (7)..(7): Xaa is Cys or D-Cys.
  MISC_FEATURE (9)..(9): Xaa is Asn or Thr.
  MISC_FEATURE (15)..(15): Xaa is Cys or D-Cys.
  MISC_FEATURE (16)..(16): Xaa is Lys, Tyr or is missing; provided that (a) one or more of Xaa3, Xaa7 and Xaa15 is D-Cys when Xaa16 is other than Lys; and (b) the peptide does not consist of the sequence D-Cys Cys Glu Leu Cys Cys Asn Pro Ala Cys Thr Gly Cys.
XXXCEXXCXPACTGXX

SEQ ID NO: 8 - protein, 14 aa, Artificial Sequence
  Synthetically generated peptide
  misc_feature (13)..(13): Xaa can be Cys or D-Cys
CCEVCCNPACTGXK

SEQ ID NO: 9 - protein, 14 aa, Artificial Sequence
  Synthetically generated peptide
  misc_feature (13)..(13): Xaa can be Cys or D-Cys
CCEVCCNPACTGXY

SEQ ID NO: 10 - protein, 13 aa, Artificial Sequence
  Synthetically generated peptide
CCEVCCTPACTGC

SEQ ID NO: 11 - protein, 14 aa, Artificial Sequence
  Synthetically generated peptide
CCEVCCTPACTGCK

SEQ ID NO: 12 - protein, 14 aa, Artificial Sequence
  Synthetically generated peptide
CCEVCCTPACTGCY

SEQ ID NO: 13 - protein, 13 aa, Artificial Sequence
  Synthetically generated peptide
  misc_feature (13)..(13): Xaa can be Cys or D-Cys
CCEVCCTPACTGX

SEQ ID NO: 14 - protein, 14 aa, Artificial Sequence
  Synthetically generated peptide
  misc_feature (13)..(13): Xaa can be Cys or D-Cys
CCEVCCTPACTGXK

SEQ ID NO: 15 - protein, 14 aa, Artificial Sequence
  Synthetically generated peptide
  misc_feature (13)..(13): Xaa can be Cys or D-Cys
CCEVCCTPACTGXY

SEQ ID NO: 16 - protein, 13 aa, Artificial Sequence
  Synthetically generated peptide
  misc_feature (5)..(5): Xaa can be Cys or D-Cys
CCEVXCNPACTGC

SEQ ID NO: 17 - protein, 14 aa, Artificial Sequence
  Synthetically generated peptide
  misc_feature (5)..(5): Xaa can be Cys or D-Cys
CCEVXCNPACTGCK

SEQ ID NO: 18 - protein, 14 aa, Artificial Sequence
  Synthetically generated peptide
  misc_feature (5)..(5): Xaa can be Cys or D-Cys
CCEVXCNPACTGCY

SEQ ID NO: 19 - protein, 13 aa, Artificial Sequence
  Synthetically generated peptide
  misc_feature (5)..(5): Xaa can be Cys or D-Cys
  misc_feature (13)..(13): Xaa can be Cys or D-Cys
CCEVXCNPACTGX

SEQ ID NO: 20 - protein, 14 aa, Artificial Sequence
  Synthetically generated peptide
  misc_feature (5)..(5): Xaa can be Cys or D-Cys
  misc_feature (13)..(13): Xaa can be Cys or D-Cys
CCEVXCNPACTGXK

SEQ ID NO: 21 - protein, 14 aa, Artificial Sequence
  Synthetically generated peptide
  misc_feature (5)..(5): Xaa can be Cys or D-Cys
  misc_feature (13)..(13): Xaa can be Cys or D-Cys
CCEVXCNPACTGXY

SEQ ID NO: 22 - protein, 13 aa, Artificial Sequence
  Synthetically generated peptide
  misc_feature (5)..(5): Xaa can be Cys or D-Cys
CCEVXCTPACTGC

SEQ ID NO: 23 - protein, 14 aa, Artificial Sequence
  Synthetically generated peptide
  misc_feature (5)..(5): Xaa can be Cys or D-Cys
CCEVXCTPACTGCK

SEQ ID NO: 24 - protein, 14 aa, Artificial Sequence
  Synthetically generated peptide
  misc_feature (5)..(5): Xaa can be Cys or D-Cys
CCEVXCTPACTGCY

SEQ ID NO: 25 - protein, 13 aa, Artificial Sequence
  Synthetically generated peptide
  misc_feature (5)..(5): Xaa can be Cys or D-Cys
  misc_feature (13)..(13): Xaa can be Cys or D-Cys
CCEVXCTPACTGX

SEQ ID NO: 26 - protein, 14 aa, Artificial Sequence
  Synthetically generated peptide
  misc_feature (5)..(5): Xaa can be Cys or D-Cys
  misc_feature (13)..(13): Xaa can be Cys or D-Cys
CCEVXCTPACTGXK

SEQ ID NO: 27 - protein, 14 aa, Artificial Sequence
  Synthetically generated peptide
  misc_feature (5)..(5): Xaa can be Cys or D-Cys
  misc_feature (13)..(13): Xaa can be Cys or D-Cys
CCEVXCTPACTGXY

SEQ ID NO: 28 - protein, 13 aa, Artificial Sequence
  Synthetically generated peptide
CCEICCNPACTGC

SEQ ID NO: 29 - protein, 14 aa, Artificial Sequence
  Synthetically generated peptide
CCEICCNPACTGCK

SEQ ID NO: 30 - protein, 14 aa, Artificial Sequence
  Synthetically generated peptide
CCEICCNPACTGCY

SEQ ID NO: 31 - protein, 13 aa, Artificial Sequence
  Synthetically generated peptide
  misc_feature (13)..(13): Xaa can be Cys or D-Cys
CCEICCNPACTGX

SEQ ID NO: 32 - protein, 14 aa, Artificial Sequence
  Synthetically generated peptide
  misc_feature (13)..(13): Xaa can be Cys or D-Cys
CCEICCNPACTGXK

SEQ ID NO: 33 - protein, 14 aa, Artificial Sequence
  Synthetically generated peptide
  misc_feature (13)..(13): Xaa can be Cys or D-Cys
CCEICCNPACTGXY

SEQ ID NO: 34 - protein, 13 aa, Artificial Sequence
  Synthetically generated peptide
CCEICCTPACTGC

SEQ ID NO: 35 - protein, 14 aa, Artificial Sequence
  Synthetically generated peptide
CCEICCTPACTGCK

SEQ ID NO: 36 - protein, 14 aa, Artificial Sequence
  Synthetically generated peptide
CCEICCTPACTGCY

SEQ ID NO: 37 - protein, 13 aa, Artificial Sequence
  Synthetically generated peptide
  misc_feature (13)..(13): Xaa can be Cys or D-Cys
CCEICCTPACTGX

SEQ ID NO: 38 - protein, 14 aa, Artificial Sequence
  Synthetically generated peptide
  misc_feature (13)..(13): Xaa can be Cys or D-Cys
CCEICCTPACTGXK

SEQ ID NO: 39 - protein, 14 aa, Artificial Sequence
  Synthetically generated peptide
  misc_feature (13)..(13): Xaa can be Cys or D-Cys
CCEICCTPACTGXY

SEQ ID NO: 40 - protein, 13 aa, Artificial Sequence
  Synthetically generated peptide
  misc_feature (5)..(5): Xaa can be Cys or D-Cys
CCEIXCNPACTGC

SEQ ID NO: 41 - protein, 14 aa, Artificial Sequence
  Synthetically generated peptide
  misc_feature (5)..(5): Xaa can be Cys or D-Cys
CCEIXCNPACTGCK

SEQ ID NO: 42 - protein, 14 aa, Artificial Sequence
  Synthetically generated peptide
  misc_feature (5)..(5): Xaa can be Cys or D-Cys
CCEIXCNPACTGCY

SEQ ID NO: 43 - protein, 13 aa, Artificial Sequence
  Synthetically generated peptide
  misc_feature (5)..(5): Xaa can be Cys or D-Cys
  misc_feature (13)..(13): Xaa can be Cys or D-Cys
CCEIXCNPACTGX

SEQ ID NO: 44 - protein, 14 aa, Artificial Sequence
  Synthetically generated peptide
  misc_feature (5)..(5): Xaa can be Cys or D-Cys
  misc_feature (13)..(13): Xaa can be Cys or D-Cys
CCEIXCNPACTGXK

SEQ ID NO: 45 - protein, 14 aa, Artificial Sequence
  Synthetically generated peptide
  misc_feature (5)..(5): Xaa can be Cys or D-Cys
  misc_feature (13)..(13): Xaa can be Cys or D-Cys
CCEIXCNPACTGXY

SEQ ID NO: 46 - protein, 13 aa, Artificial Sequence
  Synthetically generated peptide
  misc_feature (5)..(5): Xaa can be Cys or D-Cys
CCEIXCTPACTGC

SEQ ID NO: 47 - protein, 14 aa, Artificial Sequence
  Synthetically generated peptide
  misc_feature (5)..(5): Xaa can be Cys or D-Cys
CCEIXCTPACTGCK

SEQ ID NO: 48 - protein, 14 aa, Artificial Sequence
  Synthetically generated peptide
  misc_feature (5)..(5): Xaa can be Cys or D-Cys
CCEIXCTPACTGCY

SEQ ID NO: 49 - protein, 13 aa, Artificial Sequence
  Synthetically generated peptide
  misc_feature (5)..(5): Xaa can be Cys or D-Cys
  misc_feature (13)..(13): Xaa can be Cys or D-Cys
CCEIXCTPACTGX

SEQ ID NO: 50 - protein, 14 aa, Artificial Sequence
  Synthetically generated peptide
  misc_feature (5)..(5): Xaa can be Cys or D-Cys
  misc_feature (13)..(13): Xaa can be Cys or D-Cys
CCEIXCTPACTGXK

SEQ ID NO: 51 - protein, 14 aa, Artificial Sequence
  Synthetically generated peptide
  misc_feature (5)..(5): Xaa can be Cys or D-Cys
  misc_feature (13)..(13): Xaa can be Cys or D-Cys
CCEIXCTPACTGXY

SEQ ID NO: 52 - protein, 13 aa, Artificial Sequence
  Synthetically generated peptide
CCELCCNPACTGC

SEQ ID NO: 53 - protein, 14 aa, Artificial Sequence
  Synthetically generated peptide
CCELCCNPACTGCK

SEQ ID NO: 54 - protein, 14 aa, Artificial Sequence
  Synthetically generated peptide
CCELCCNPACTGCY

SEQ ID NO: 55 - protein, 13 aa, Artificial Sequence
  Synthetically generated peptide
  misc_feature (13)..(13): Xaa can be Cys or D-Cys
CCELCCNPACTGX

SEQ ID NO: 56 - protein, 14 aa, Artificial Sequence
  Synthetically generated peptide
  misc_feature (13)..(13): Xaa can be Cys or D-Cys
CCELCCNPACTGXK

SEQ ID NO: 57 - protein, 14 aa, Artificial Sequence
  Synthetically generated peptide
  misc_feature (13)..(13): Xaa can be Cys or D-Cys
CCELCCNPACTGXY

SEQ ID NO: 58 - protein, 13 aa, Artificial Sequence
  Synthetically generated peptide
CCELCCTPACTGC

SEQ ID NO: 59 - protein, 14 aa, Artificial Sequence
  Synthetically generated peptide
CCELCCTPACTGCK

SEQ ID NO: 60 - protein, 14 aa, Artificial Sequence
  Synthetically generated peptide
CCELCCTPACTGCY

SEQ ID NO: 61 - protein, 13 aa, Artificial Sequence
  Synthetically generated peptide
  misc_feature (13)..(13): Xaa can be Cys or D-Cys
CCELCCTPACTGX

SEQ ID NO: 62 - protein, 14 aa, Artificial Sequence
  Synthetically generated peptide
  misc_feature (13)..(13): Xaa can be Cys or D-Cys
CCELCCTPACTGXK

SEQ ID NO: 63 - protein, 14 aa, Artificial Sequence
  Synthetically generated peptide
  misc_feature (13)..(13): Xaa can be Cys or D-Cys
CCELCCTPACTGXY

SEQ ID NO: 64 - protein, 13 aa, Artificial Sequence
  Synthetically generated peptide
  misc_feature (5)..(5): Xaa can be Cys or D-Cys
CCELXCNPACTGC

SEQ ID NO: 65 - protein, 14 aa, Artificial Sequence
  Synthetically generated peptide
  misc_feature (5)..(5): Xaa can be Cys or D-Cys
CCELXCNPACTGCK

SEQ ID NO: 66 - protein, 14 aa, Artificial Sequence
  Synthetically generated peptide
  misc_feature (5)..(5): Xaa can be Cys or D-Cys
CCELXCNPACTGCY

SEQ ID NO: 67 - protein, 13 aa, Artificial Sequence
  Synthetically generated peptide
  misc_feature (5)..(5): Xaa can be Cys or D-Cys
  misc_feature (13)..(13): Xaa can be Cys or D-Cys
CCELXCNPACTGX

SEQ ID NO: 68 - protein, 14 aa, Artificial Sequence
  Synthetically generated peptide
  misc_feature (5)..(5): Xaa can be Cys or D-Cys
  misc_feature (13)..(13): Xaa can be Cys or D-Cys
CCELXCNPACTGXK

SEQ ID NO: 69 - protein, 14 aa, Artificial Sequence
  Synthetically generated peptide
  misc_feature (5)..(5): Xaa can be Cys or D-Cys
  misc_feature (13)..(13): Xaa can be Cys or D-Cys
CCELXCNPACTGXY

SEQ ID NO: 70 - protein, 13 aa, Artificial Sequence
  Synthetically generated peptide
  misc_feature (5)..(5): Xaa can be Cys or D-Cys
CCELXCTPACTGC

SEQ ID NO: 71 - protein, 14 aa, Artificial Sequence
  Synthetically generated peptide
  misc_feature (5)..(5): Xaa can be Cys or D-Cys
CCELXCTPACTGCK

SEQ ID NO: 72 - protein, 14 aa, Artificial Sequence
  Synthetically generated peptide
  misc_feature (5)..(5): Xaa can be Cys or D-Cys
CCELXCTPACTGCY

SEQ ID NO: 73 - protein, 13 aa, Artificial Sequence
  Synthetically generated peptide
  misc_feature (5)..(5): Xaa can be Cys or D-Cys
  misc_feature (13)..(13): Xaa can be Cys or D-Cys
CCELXCTPACTGX

SEQ ID NO: 74 - protein, 14 aa, Artificial Sequence
  Synthetically generated peptide
  misc_feature (5)..(5): Xaa can be Cys or D-Cys
  misc_feature (13)..(13): Xaa can be Cys or D-Cys
CCELXCTPACTGXK

SEQ ID NO: 75 - protein, 14 aa, Artificial Sequence
  Synthetically generated peptide
  misc_feature (5)..(5): Xaa can be Cys or D-Cys
  misc_feature (13)..(13): Xaa can be Cys or D-Cys
CCELXCTPACTGXY

SEQ ID NO: 76 - protein, 13 aa, Artificial Sequence
  Synthetically generated peptide
CCEYCCNPACTGC

SEQ ID NO: 77 - protein, 14 aa, Artificial Sequence
  Synthetically generated peptide
CCEYCCNPACTGCK

SEQ ID NO: 78 - protein, 14 aa, Artificial Sequence
  Synthetically generated peptide
CCEYCCNPACTGCY

SEQ ID NO: 79 - protein, 13 aa, Artificial Sequence
  Synthetically generated peptide
  misc_feature (13)..(13): Xaa can be Cys or D-Cys
CCEYCCNPACTGX

SEQ ID NO: 80 - protein, 14 aa, Artificial Sequence
  Synthetically generated peptide
  misc_feature (13)..(13): Xaa can be Cys or D-Cys
CCEYCCNPACTGXK

SEQ ID NO: 81 - protein, 14 aa, Artificial Sequence
  Synthetically generated peptide
  misc_feature (13)..(13): Xaa can be Cys or D-Cys
CCEYCCNPACTGXY

SEQ ID NO: 82 - protein, 13 aa, Artificial Sequence
  Synthetically generated peptide
CCEYCCTPACTGC

SEQ ID NO: 83 - protein, 14 aa, Artificial Sequence
  Synthetically generated peptide
CCEYCCTPACTGCK

SEQ ID NO: 84 - protein, 14 aa, Artificial Sequence
  Synthetically generated peptide
CCEYCCTPACTGCY

SEQ ID NO: 85 - protein, 13 aa, Artificial Sequence
  Synthetically generated peptide
  misc_feature (13)..(13): Xaa can be Cys or D-Cys
CCEYCCTPACTGX

SEQ ID NO: 86 - protein, 14 aa, Artificial Sequence
  Synthetically generated peptide
  misc_feature (13)..(13): Xaa can be Cys or D-Cys
CCEYCCTPACTGXK

SEQ ID NO: 87 - protein, 14 aa, Artificial Sequence
  Synthetically generated peptide
  misc_feature (13)..(13): Xaa can be Cys or D-Cys
CCEYCCTPACTGXY

SEQ ID NO: 88 - protein, 13 aa, Artificial Sequence
  Synthetically generated peptide
  misc_feature (5)..(5): Xaa can be Cys or D-Cys
CCEYXCNPACTGC

SEQ ID NO: 89 - protein, 14 aa, Artificial Sequence
  Synthetically generated peptide
  misc_feature (5)..(5): Xaa can be Cys or D-Cys
CCEYXCNPACTGCK

SEQ ID NO: 90 - protein, 14 aa, Artificial Sequence
  Synthetically generated peptide
  misc_feature (5)..(5): Xaa can be Cys or D-Cys
CCEYXCNPACTGCY

SEQ ID NO: 91 - protein, 13 aa, Artificial Sequence
  Synthetically generated peptide
  misc_feature (5)..(5): Xaa can be Cys or D-Cys
  misc_feature (13)..(13): Xaa can be Cys or D-Cys
CCEYXCNPACTGX

SEQ ID NO: 92 - protein, 14 aa, Artificial Sequence
  Synthetically generated peptide
  misc_feature (5)..(5): Xaa can be Cys or D-Cys
  misc_feature (13)..(13): Xaa can be Cys or D-Cys
CCEYXCNPACTGXK

SEQ ID NO: 93 - protein, 14 aa, Artificial Sequence
  Synthetically generated peptide
  misc_feature (5)..(5): Xaa can be Cys or D-Cys
  misc_feature (13)..(13): Xaa can be Cys or D-Cys
CCEYXCNPACTGXY

SEQ ID NO: 94 - protein, 13 aa, Artificial Sequence
  Synthetically generated peptide
  misc_feature (5)..(5): Xaa can be Cys or D-Cys
CCEYXCTPACTGC

SEQ ID NO: 95 - protein, 14 aa, Artificial Sequence
  Synthetically generated peptide
  misc_feature (5)..(5): Xaa can be Cys or D-Cys
CCEYXCTPACTGCK

SEQ ID NO: 96 - protein, 14 aa, Artificial Sequence
  Synthetically generated peptide
  misc_feature (5)..(5): Xaa can be Cys or D-Cys
CCEYXCTPACTGCY

SEQ ID NO: 97 - protein, 13 aa, Artificial Sequence
  Synthetically generated peptide
  misc_feature (5)..(5): Xaa can be Cys or D-Cys
  misc_feature (13)..(13): Xaa can be Cys or D-Cys
CCEYXCTPACTGX

SEQ ID NO: 98 - protein, 14 aa, Artificial Sequence
  Synthetically generated peptide
  misc_feature (5)..(5): Xaa can be Cys or D-Cys
  misc_feature (13)..(13): Xaa can be Cys or D-Cys
CCEYXCTPACTGXK

SEQ ID NO: 99 - protein, 14 aa, Artificial Sequence
  Synthetically generated peptide
  misc_feature (5)..(5): Xaa can be Cys or D-Cys
  misc_feature (13)..(13): Xaa can be Cys or D-Cys
CCEYXCTPACTGXY

SEQ ID NO: 100 - protein, 13 aa, Artificial Sequence
  Synthetically generated peptide
CCEFCCNPACTGC

SEQ ID NO: 101 - protein, 14 aa, Artificial Sequence
  Synthetically generated peptide
CCEFCCNPACTGCK

SEQ ID NO: 102 - protein, 14 aa, Artificial Sequence
  Synthetically generated peptide
CCEFCCNPACTGCY

SEQ ID NO: 103 - protein, 13 aa, Artificial Sequence
  Synthetically generated peptide
  misc_feature (13)..(13): Xaa can be Cys or D-Cys
CCEFCCNPACTGX

SEQ ID NO: 104 - protein, 14 aa, Artificial Sequence
  Synthetically generated peptide
  misc_feature (13)..(13): Xaa can be Cys or D-Cys
CCEFCCNPACTGXK

SEQ ID NO: 105 - protein, 14 aa, Artificial Sequence
  Synthetically generated peptide
  misc_feature (13)..(13): Xaa can be Cys or D-Cys
CCEFCCNPACTGXY

SEQ ID NO: 106 - protein, 13 aa, Artificial Sequence
  Synthetically generated peptide
CCEFCCTPACTGC

SEQ ID NO: 107 - protein, 14 aa, Artificial Sequence
  Synthetically generated peptide
CCEFCCTPACTGCK

SEQ ID NO: 108 - protein, 14 aa, Artificial Sequence
  Synthetically generated peptide
CCEFCCTPACTGCY

SEQ ID NO: 109 - protein, 13 aa, Artificial Sequence
  Synthetically generated peptide
  misc_feature (13)..(13): Xaa can be Cys or D-Cys
CCEFCCTPACTGX

SEQ ID NO: 110 - protein, 14 aa, Artificial Sequence
  Synthetically generated peptide
  misc_feature (13)..(13): Xaa can be Cys or D-Cys
CCEFCCTPACTGXK

SEQ ID NO: 111 - protein, 14 aa, Artificial Sequence
  Synthetically generated peptide
  misc_feature (13)..(13): Xaa can be Cys or D-Cys
CCEFCCTPACTGXY

SEQ ID NO: 112 - protein, 13 aa, Artificial Sequence
  Synthetically generated peptide
  misc_feature (5)..(5): Xaa can be Cys or D-Cys
CCEFXCNPACTGC

SEQ ID NO: 113 - protein, 14 aa, Artificial Sequence
  Synthetically generated peptide
  misc_feature (5)..(5): Xaa can be Cys or D-Cys
CCEFXCNPACTGCK

SEQ ID NO: 114 - protein, 14 aa, Artificial Sequence
  Synthetically generated peptide
  misc_feature (5)..(5): Xaa can be Cys or D-Cys
CCEFXCNPACTGCY

SEQ ID NO: 115 - protein, 13 aa, Artificial Sequence
  Synthetically generated peptide
  misc_feature (5)..(5): Xaa can be Cys or D-Cys
  misc_feature (13)..(13): Xaa can be Cys or D-Cys
CCEFXCNPACTGX

SEQ ID NO: 116 - protein, 14 aa, Artificial Sequence
  Synthetically generated peptide
  misc_feature (5)..(5): Xaa can be Cys or D-Cys
  misc_feature (13)..(13): Xaa can be Cys or D-Cys
CCEFXCNPACTGXK

SEQ ID NO: 117 - protein, 14 aa, Artificial Sequence
  Synthetically generated peptide
  misc_feature (5)..(5): Xaa can be Cys or D-Cys
  misc_feature (13)..(13): Xaa can be Cys or D-Cys
CCEFXCNPACTGXY

SEQ ID NO: 118 - protein, 13 aa, Artificial Sequence
  Synthetically generated peptide
  misc_feature (5)..(5): Xaa can be Cys or D-Cys
CCEFXCTPACTGC

SEQ ID NO: 119 - protein, 14 aa, Artificial Sequence
  Synthetically generated peptide
  misc_feature (5)..(5): Xaa can be Cys or D-Cys
CCEFXCTPACTGCK

SEQ ID NO: 120 - protein, 14 aa, Artificial Sequence
  Synthetically generated peptide
  misc_feature (5)..(5): Xaa can be Cys or D-Cys
CCEFXCTPACTGCY

SEQ ID NO: 121 - protein, 13 aa, Artificial Sequence
  Synthetically generated peptide
  misc_feature (5)..(5): Xaa can be Cys or D-Cys
  misc_feature (13)..(13): Xaa can be Cys or D-Cys
CCEFXCTPACTGX

SEQ ID NO: 122 - protein, 14 aa, Artificial Sequence
  Synthetically generated peptide
  misc_feature (5)..(5): Xaa can be Cys or D-Cys
  misc_feature (13)..(13): Xaa can be Cys or D-Cys
CCEFXCTPACTGXK

SEQ ID NO: 123 - protein, 14 aa, Artificial Sequence
  Synthetically generated peptide
  misc_feature (5)..(5): Xaa can be Cys or D-Cys
  misc_feature (13)..(13): Xaa can be Cys or D-Cys
CCEFXCTPACTGXY

SEQ ID NO: 124 - protein, 13 aa, Artificial Sequence
  Synthetically generated peptide
CCEWCCNPACTGC

SEQ ID NO: 125 - protein, 14 aa, Artificial Sequence
  Synthetically generated peptide
CCEWCCNPACTGCK

SEQ ID NO: 126 - protein, 14 aa, Artificial Sequence
  Synthetically generated peptide
CCEWCCNPACTGCY

SEQ ID NO: 127 - protein, 13 aa, Artificial Sequence
  Synthetically generated peptide
  misc_feature (13)..(13): Xaa can be Cys or D-Cys
CCEWCCNPACTGX

SEQ ID NO: 128 - protein, 14 aa, Artificial Sequence
  Synthetically generated peptide
  misc_feature (13)..(13): Xaa can be Cys or D-Cys
CCEWCCNPACTGXK

SEQ ID NO: 129 - protein, 14 aa, Artificial Sequence
  Synthetically generated peptide
  misc_feature (13)..(13): Xaa can be Cys or D-Cys
CCEWCCNPACTGXY

SEQ ID NO: 130 - protein, 13 aa, Artificial Sequence
  Synthetically generated peptide
CCEWCCTPACTGC

SEQ ID NO: 131 - protein, 14 aa, Artificial Sequence
  Synthetically generated peptide
CCEWCCTPACTGCK

SEQ ID NO: 132 - protein, 14 aa, Artificial Sequence
  Synthetically generated peptide
CCEWCCTPACTGCY

SEQ ID NO: 133 - protein, 13 aa, Artificial Sequence
  Synthetically generated peptide
  misc_feature (13)..(13): Xaa can be Cys or D-Cys
CCEWCCTPACTGX

SEQ ID NO: 134 - protein, 14 aa, Artificial Sequence
  Synthetically generated peptide
  misc_feature (13)..(13): Xaa can be Cys or D-Cys
CCEWCCTPACTGXK

SEQ ID NO: 135 - protein, 14 aa, Artificial Sequence
  Synthetically generated peptide
  misc_feature (13)..(13): Xaa can be Cys or D-Cys
CCEWCCTPACTGXY

SEQ ID NO: 136 - protein, 13 aa, Artificial Sequence
  Synthetically generated peptide
  misc_feature (5)..(5): Xaa can be Cys or D-Cys
CCEWXCNPACTGC

SEQ ID NO: 137 - protein, 14 aa, Artificial Sequence
  Synthetically generated peptide
  misc_feature (5)..(5): Xaa can be Cys or D-Cys
CCEWXCNPACTGCK

SEQ ID NO: 138 - protein, 14 aa, Artificial Sequence
  Synthetically generated peptide
  misc_feature (5)..(5): Xaa can be Cys or D-Cys
CCEWXCNPACTGCY

SEQ ID NO: 139 - protein, 13 aa, Artificial Sequence
  Synthetically generated peptide
  misc_feature (5)..(5): Xaa can be Cys or D-Cys
  misc_feature (13)..(13): Xaa can be Cys or D-Cys
CCEWXCNPACTGX

SEQ ID NO: 140 - protein, 14 aa, Artificial Sequence
  Synthetically generated peptide
  misc_feature (5)..(5): Xaa can be Cys or D-Cys
  misc_feature (13)..(13): Xaa can be Cys or D-Cys
CCEWXCNPACTGXK

SEQ ID NO: 141 - protein, 14 aa, Artificial Sequence
  Synthetically generated peptide
  misc_feature (5)..(5): Xaa can be Cys or D-Cys
  misc_feature (13)..(13): Xaa can be Cys or D-Cys
CCEWXCNPACTGXY

SEQ ID NO: 142 - protein, 13 aa, Artificial Sequence
  Synthetically generated peptide
  misc_feature (5)..(5): Xaa can be Cys or D-Cys
CCEWXCTPACTGC

SEQ ID NO: 143 - protein, 14 aa, Artificial Sequence
  Synthetically generated peptide
  misc_feature (5)..(5): Xaa can be Cys or D-Cys
CCEWXCTPACTGCK

SEQ ID NO: 144 - protein, 14 aa, Artificial Sequence
  Synthetically generated peptide
  misc_feature (5)..(5): Xaa can be Cys or D-Cys
CCEWXCTPACTGCY

SEQ ID NO: 145 - protein, 13 aa, Artificial Sequence
  Synthetically generated peptide
  misc_feature (5)..(5): Xaa can be Cys or D-Cys
  misc_feature (13)..(13): Xaa can be Cys or D-Cys
CCEWXCTPACTGX

SEQ ID NO: 146 - protein, 14 aa, Artificial Sequence
  Synthetically generated peptide
  misc_feature (5)..(5): Xaa can be Cys or D-Cys
  misc_feature (13)..(13): Xaa can be Cys or D-Cys
CCEWXCTPACTGXK

SEQ ID NO: 147 - protein, 14 aa, Artificial Sequence
  Synthetically generated peptide
  misc_feature (5)..(5): Xaa can be Cys or D-Cys
  misc_feature (13)..(13): Xaa can be Cys or D-Cys
CCEWXCTPACTGXY

SEQ ID NO: 148 - protein, 13 aa, Artificial Sequence
  Synthetically generated peptide
  misc_feature (1)..(1): Xaa can be Cys or D-Cys
XCEVCCNPACTGC

SEQ ID NO: 149 - protein, 14 aa, Artificial Sequence
  Synthetically generated peptide
  misc_feature (1)..(1): Xaa can be Cys or D-Cys
XCEVCCNPACTGCK

SEQ ID NO: 150 - protein, 14 aa, Artificial Sequence
  Synthetically generated peptide
  misc_feature (1)..(1): Xaa can be Cys or D-Cys
XCEVCCNPACTGCY

SEQ ID NO: 151 - protein, 13 aa, Artificial Sequence
  Synthetically generated peptide
  misc_feature (1)..(1): Xaa can be Cys or D-Cys
  misc_feature (13)..(13): Xaa can be Cys or D-Cys
XCEVCCNPACTGX

SEQ ID NO: 152 - protein, 14 aa, Artificial Sequence
  Synthetically generated peptide
  misc_feature (1)..(1): Xaa can be Cys or D-Cys
  misc_feature (13)..(13): Xaa can be Cys or D-Cys
XCEVCCNPACTGXK

SEQ ID NO: 153 - protein, 14 aa, Artificial Sequence
  Synthetically generated peptide
  misc_feature (1)..(1): Xaa can be Cys or D-Cys
  misc_feature (13)..(13): Xaa can be Cys or D-Cys
XCEVCCNPACTGXY

SEQ ID NO: 154 - protein, 13 aa, Artificial Sequence
  Synthetically generated peptide
  misc_feature (1)..(1): Xaa can be Cys or D-Cys
XCEVCCTPACTGC

SEQ ID NO: 155 - protein, 14 aa, Artificial Sequence
  Synthetically generated peptide
  misc_feature (1)..(1): Xaa can be Cys or D-Cys
XCEVCCTPACTGCK

SEQ ID NO: 156 - protein, 14 aa, Artificial Sequence
  Synthetically generated peptide
  misc_feature (1)..(1): Xaa can be Cys or D-Cys
XCEVCCTPACTGCY

SEQ ID NO: 157 - protein, 13 aa, Artificial Sequence
  Synthetically generated peptide
  misc_feature (1)..(1): Xaa can be Cys or D-Cys
  misc_feature (13)..(13): Xaa can be Cys or D-Cys
XCEVCCTPACTGX

SEQ ID NO: 158 - protein, 14 aa, Artificial Sequence
  Synthetically generated peptide
  misc_feature (1)..(1): Xaa can be Cys or D-Cys
  misc_feature (13)..(13): Xaa can be Cys or D-Cys
XCEVCCTPACTGXK

SEQ ID NO: 159 - protein, 14 aa, Artificial Sequence
  Synthetically generated peptide
  misc_feature (1)..(1): Xaa can be Cys or D-Cys
  misc_feature (13)..(13): Xaa can be Cys or D-Cys
XCEVCCTPACTGXY

SEQ ID NO: 160 - protein, 13 aa, Artificial Sequence
  Synthetically generated peptide
  misc_feature (1)..(1): Xaa can be Cys or D-Cys
  misc_feature (5)..(5): Xaa can be Cys or D-Cys
XCEVXCNPACTGC

SEQ ID NO: 161 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
XCEVXCNPACTGCK

SEQ ID NO: 162 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
XCEVXCNPACTGCY

SEQ ID NO: 163 - protein, 13 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCEVXCNPACTGX

SEQ ID NO: 164 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCEVXCNPACTGXK

SEQ ID NO: 165 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCEVXCNPACTGXY

SEQ ID NO: 166 - protein, 13 aa, Artificial Sequence
  Synthetically generated peptide
  misc_feature (1)..(1): Xaa can be Cys or D-Cys
  misc_feature (5)..(5): Xaa can be Cys or D-Cys
XCEVXCTPACTGC

SEQ ID NO: 167 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
XCEVXCTPACTGCK

SEQ ID NO: 168 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
XCEVXCTPACTGCY

SEQ ID NO: 169 - protein, 13 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCEVXCTPACTGX

SEQ ID NO: 170 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCEVXCTPACTGXK

SEQ ID NO: 171 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCEVXCTPACTGXY

SEQ ID NO: 172 - protein, 13 aa, Artificial Sequence
  Synthetically generated peptide
  misc_feature (1)..(1): Xaa can be Cys or D-Cys
XCEICCNPACTGC

SEQ ID NO: 173 - protein, 14 aa, Artificial Sequence
  Synthetically generated peptide
  misc_feature (1)..(1): Xaa can be Cys or D-Cys
XCEICCNPACTGCK

SEQ ID NO: 174 - protein, 14 aa, Artificial Sequence
  Synthetically generated peptide
  misc_feature (1)..(1): Xaa can be Cys or D-Cys
XCEICCNPACTGCY

SEQ ID NO: 175 - protein, 13 aa, Artificial Sequence
  Synthetically generated peptide
  misc_feature (1)..(1): Xaa can be Cys or D-Cys
  misc_feature (13)..(13): Xaa can be Cys or D-Cys
XCEICCNPACTGX

SEQ ID NO: 176 - protein, 14 aa, Artificial Sequence
  Synthetically generated peptide
  misc_feature (1)..(1): Xaa can be Cys or D-Cys
  misc_feature (13)..(13): Xaa can be Cys or D-Cys
XCEICCNPACTGXK

SEQ ID NO: 177 - protein, 14 aa, Artificial Sequence
  Synthetically generated peptide
  misc_feature (1)..(1): Xaa can be Cys or D-Cys
  misc_feature (13)..(13): Xaa can be Cys or D-Cys
XCEICCNPACTGXY

SEQ ID NO: 178 - protein, 13 aa, Artificial Sequence
  Synthetically generated peptide
  misc_feature (1)..(1): Xaa can be Cys or D-Cys
XCEICCTPACTGC

SEQ ID NO: 179 - protein, 14 aa, Artificial Sequence
  Synthetically generated peptide
  misc_feature (1)..(1): Xaa can be Cys or D-Cys
XCEICCTPACTGCK

SEQ ID NO: 180 - protein, 14 aa, Artificial Sequence
  Synthetically generated peptide
  misc_feature (1)..(1): Xaa can be Cys or D-Cys
XCEICCTPACTGCY

SEQ ID NO: 181 - protein, 13 aa, Artificial Sequence
  Synthetically generated peptide
  misc_feature (1)..(1): Xaa can be Cys or D-Cys
  misc_feature (13)..(13): Xaa can be Cys or D-Cys
XCEICCTPACTGX

SEQ ID NO: 182 - protein, 14 aa, Artificial Sequence
  Synthetically generated peptide
  misc_feature (1)..(1): Xaa can be Cys or D-Cys
  misc_feature (13)..(13): Xaa can be Cys or D-Cys
XCEICCTPACTGXK

SEQ ID NO: 183 - protein, 14 aa, Artificial Sequence
  Synthetically generated peptide
  misc_feature (1)..(1): Xaa can be Cys or D-Cys
  misc_feature (13)..(13): Xaa can be Cys or D-Cys
XCEICCTPACTGXY

SEQ ID NO: 184 - protein, 13 aa, Artificial Sequence
  Synthetically generated peptide
  misc_feature (1)..(1): Xaa can be Cys or D-Cys
  misc_feature (5)..(5): Xaa can be Cys or D-Cys
XCEIXCNPACTGC

SEQ ID NO: 185 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
XCEIXCNPACTGCK

SEQ ID NO: 186 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
XCEIXCNPACTGCY

SEQ ID NO: 187 - protein, 13 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCEIXCNPACTGX

SEQ ID NO: 188 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCEIXCNPACTGXK

SEQ ID NO: 189 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCEIXCNPACTGXY

SEQ ID NO: 190 - protein, 13 aa, Artificial Sequence
  Synthetically generated peptide
  misc_feature (1)..(1): Xaa can be Cys or D-Cys
  misc_feature (5)..(5): Xaa can be Cys or D-Cys
XCEIXCTPACTGC

SEQ ID NO: 191 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
XCEIXCTPACTGCK

SEQ ID NO: 192 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
XCEIXCTPACTGCY

SEQ ID NO: 193 - protein, 13 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCEIXCTPACTGX

SEQ ID NO: 194 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCEIXCTPACTGXK

SEQ ID NO: 195 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCEIXCTPACTGXY

SEQ ID NO: 196 - protein, 13 aa, Artificial Sequence
  Synthetically generated peptide
  misc_feature (1)..(1): Xaa can be Cys or D-Cys
XCELCCNPACTGC

SEQ ID NO: 197 - protein, 14 aa, Artificial Sequence
  Synthetically generated peptide
  misc_feature (1)..(1): Xaa can be Cys or D-Cys
XCELCCNPACTGCK

SEQ ID NO: 198 - protein, 14 aa, Artificial Sequence
  Synthetically generated peptide
  misc_feature (1)..(1): Xaa can be Cys or D-Cys
XCELCCNPACTGCY

SEQ ID NO: 199 - protein, 13 aa, Artificial Sequence
  Synthetically generated peptide
  misc_feature (1)..(1): Xaa can be Cys or D-Cys
  misc_feature (13)..(13): Xaa can be Cys or D-Cys
XCELCCNPACTGX

SEQ ID NO: 200 - protein, 14 aa, Artificial Sequence
  Synthetically generated peptide
  misc_feature (1)..(1): Xaa can be Cys or D-Cys
  misc_feature (13)..(13): Xaa can be Cys or D-Cys
XCELCCNPACTGXK

SEQ ID NO: 201 - protein, 14 aa, Artificial Sequence
  Synthetically generated peptide
  misc_feature (1)..(1): Xaa can be Cys or D-Cys
  misc_feature (13)..(13): Xaa can be Cys or D-Cys
XCELCCNPACTGXY

SEQ ID NO: 202 - protein, 13 aa, Artificial Sequence
  Synthetically generated peptide
  misc_feature (1)..(1): Xaa can be Cys or D-Cys
XCELCCTPACTGC

SEQ ID NO: 203 - protein, 14 aa, Artificial Sequence
  Synthetically generated peptide
  misc_feature (1)..(1): Xaa can be Cys or D-Cys
XCELCCTPACTGCK

SEQ ID NO: 204 - protein, 14 aa, Artificial Sequence
  Synthetically generated peptide
  misc_feature (1)..(1): Xaa can be Cys or D-Cys
XCELCCTPACTGCY

SEQ ID NO: 205 - protein, 13 aa, Artificial Sequence
  Synthetically generated peptide
  misc_feature (1)..(1): Xaa can be Cys or D-Cys
  misc_feature (13)..(13): Xaa can be Cys or D-Cys
XCELCCTPACTGX

SEQ ID NO: 206 - protein, 14 aa, Artificial Sequence
  Synthetically generated peptide
  misc_feature (1)..(1): Xaa can be Cys or D-Cys
  misc_feature (13)..(13): Xaa can be Cys or D-Cys
XCELCCTPACTGXK

SEQ ID NO: 207 - protein, 14 aa, Artificial Sequence
  Synthetically generated peptide
  misc_feature (1)..(1): Xaa can be Cys or D-Cys
  misc_feature (13)..(13): Xaa can be Cys or D-Cys
XCELCCTPACTGXY

SEQ ID NO: 208 - protein, 13 aa, Artificial Sequence
  Synthetically generated peptide
  misc_feature (1)..(1): Xaa can be Cys or D-Cys
  misc_feature (5)..(5): Xaa can be Cys or D-Cys
XCELXCNPACTGC

SEQ ID NO: 209 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
XCELXCNPACTGCK

SEQ ID NO: 210 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
XCELXCNPACTGCY

SEQ ID NO: 211 - protein, 13 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCELXCNPACTGX

SEQ ID NO: 212 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCELXCNPACTGXK

SEQ ID NO: 213 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCELXCNPACTGXY

SEQ ID NO: 214 - protein, 13 aa, Artificial Sequence
  Synthetically generated peptide
  misc_feature (1)..(1): Xaa can be Cys or D-Cys
  misc_feature (5)..(5): Xaa can be Cys or D-Cys
XCELXCTPACTGC

SEQ ID NO: 215 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
XCELXCTPACTGCK

SEQ ID NO: 216 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
XCELXCTPACTGCY

SEQ ID NO: 217 - protein, 13 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCELXCTPACTGX

SEQ ID NO: 218 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCELXCTPACTGXK

SEQ ID NO: 219 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCELXCTPACTGXY

SEQ ID NO: 220 - protein, 13 aa, Artificial Sequence
  Synthetically generated peptide
  misc_feature (1)..(1): Xaa can be Cys or D-Cys
XCEYCCNPACTGC

SEQ ID NO: 221 - protein, 14 aa, Artificial Sequence
  Synthetically generated peptide
  misc_feature (1)..(1): Xaa can be Cys or D-Cys
XCEYCCNPACTGCK

SEQ ID NO: 222 - protein, 14 aa, Artificial Sequence
  Synthetically generated peptide
  misc_feature (1)..(1): Xaa can be Cys or D-Cys
XCEYCCNPACTGCY

SEQ ID NO: 223 - protein, 13 aa, Artificial Sequence
  Synthetically generated peptide
  misc_feature (1)..(1): Xaa can be Cys or D-Cys
  misc_feature (13)..(13): Xaa can be Cys or D-Cys
XCEYCCNPACTGX

SEQ ID NO: 224 - protein, 14 aa, Artificial Sequence
  Synthetically generated peptide
  misc_feature (1)..(1): Xaa can be Cys or D-Cys
  misc_feature (13)..(13): Xaa can be Cys or D-Cys
XCEYCCNPACTGXK

SEQ ID NO: 225 - protein, 14 aa, Artificial Sequence
  Synthetically generated peptide
  misc_feature (1)..(1): Xaa can be Cys or D-Cys
  misc_feature (13)..(13): Xaa can be Cys or D-Cys
XCEYCCNPACTGXY

SEQ ID NO: 226 - protein, 13 aa, Artificial Sequence
  Synthetically generated peptide
  misc_feature (1)..(1): Xaa can be Cys or D-Cys
XCEYCCTPACTGC

SEQ ID NO: 227 - protein, 14 aa, Artificial Sequence
  Synthetically generated peptide
  misc_feature (1)..(1): Xaa can be Cys or D-Cys
XCEYCCTPACTGCK

SEQ ID NO: 228 - protein, 14 aa, Artificial Sequence
  Synthetically generated peptide
  misc_feature (1)..(1): Xaa can be Cys or D-Cys
XCEYCCTPACTGCY

SEQ ID NO: 229 - protein, 13 aa, Artificial Sequence
  Synthetically generated peptide
  misc_feature (1)..(1): Xaa can be Cys or D-Cys
  misc_feature (13)..(13): Xaa can be Cys or D-Cys
XCEYCCTPACTGX

SEQ ID NO: 230 - protein, 14 aa, Artificial Sequence
  Synthetically generated peptide
  misc_feature (1)..(1): Xaa can be Cys or D-Cys
  misc_feature (13)..(13): Xaa can be Cys or D-Cys
XCEYCCTPACTGXK

SEQ ID NO: 231 - protein, 14 aa, Artificial Sequence
  Synthetically generated peptide
  misc_feature (1)..(1): Xaa can be Cys or D-Cys
  misc_feature (13)..(13): Xaa can be Cys or D-Cys
XCEYCCTPACTGXY

SEQ ID NO: 232 - protein, 13 aa, Artificial Sequence
  Synthetically generated peptide
  misc_feature (1)..(1): Xaa can be Cys or D-Cys
  misc_feature (5)..(5): Xaa can be Cys or D-Cys
XCEYXCNPACTGC

SEQ ID NO: 233 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
XCEYXCNPACTGCK

SEQ ID NO: 234 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
XCEYXCNPACTGCY

SEQ ID NO: 235 - protein, 13 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCEYXCNPACTGX

SEQ ID NO: 236 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCEYXCNPACTGXK

SEQ ID NO: 237 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCEYXCNPACTGXY

SEQ ID NO: 238 - protein, 13 aa, Artificial Sequence
  Synthetically generated peptide
  misc_feature (1)..(1): Xaa can be Cys or D-Cys
  misc_feature (5)..(5): Xaa can be Cys or D-Cys
XCEYXCTPACTGC

SEQ ID NO: 239 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
XCEYXCTPACTGCK

SEQ ID NO: 240 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
XCEYXCTPACTGCY

SEQ ID NO: 241 - protein, 13 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCEYXCTPACTGX

SEQ ID NO: 242 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCEYXCTPACTGXK

SEQ ID NO: 243 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCEYXCTPACTGXY

SEQ ID NO: 244 - protein, 13 aa, Artificial Sequence
  Synthetically generated peptide
  misc_feature (1)..(1): Xaa can be Cys or D-Cys
XCEFCCNPACTGC

SEQ ID NO: 245 - protein, 14 aa, Artificial Sequence
  Synthetically generated peptide
  misc_feature (1)..(1): Xaa can be Cys or D-Cys
XCEFCCNPACTGCK

SEQ ID NO: 246 - protein, 14 aa, Artificial Sequence
  Synthetically generated peptide
  misc_feature (1)..(1): Xaa can be Cys or D-Cys
XCEFCCNPACTGCY

SEQ ID NO: 247 - protein, 13 aa, Artificial Sequence
  Synthetically generated peptide
  misc_feature (1)..(1): Xaa can be Cys or D-Cys
  misc_feature (13)..(13): Xaa can be Cys or D-Cys
XCEFCCNPACTGX

SEQ ID NO: 248 - protein, 14 aa, Artificial Sequence
  Synthetically generated peptide
  misc_feature (1)..(1): Xaa can be Cys or D-Cys
  misc_feature (13)..(13): Xaa can be Cys or D-Cys
XCEFCCNPACTGXK

SEQ ID NO: 249 - protein, 14 aa, Artificial Sequence
  Synthetically generated peptide
  misc_feature (1)..(1): Xaa can be Cys or D-Cys
  misc_feature (13)..(13): Xaa can be Cys or D-Cys
XCEFCCNPACTGXY

SEQ ID NO: 250 - protein, 13 aa, Artificial Sequence
  Synthetically generated peptide
  misc_feature (1)..(1): Xaa can be Cys or D-Cys
XCEFCCTPACTGC

SEQ ID NO: 251 - protein, 14 aa, Artificial Sequence
  Synthetically generated peptide
  misc_feature (1)..(1): Xaa can be Cys or D-Cys
XCEFCCTPACTGCK

SEQ ID NO: 252 - protein, 14 aa, Artificial Sequence
  Synthetically generated peptide
  misc_feature (1)..(1): Xaa can be Cys or D-Cys
XCEFCCTPACTGCY

SEQ ID NO: 253 - protein, 13 aa, Artificial Sequence
  Synthetically generated peptide
  misc_feature (1)..(1): Xaa can be Cys or D-Cys
  misc_feature (13)..(13): Xaa can be Cys or D-Cys
XCEFCCTPACTGX

SEQ ID NO: 254 - protein, 14 aa, Artificial Sequence
  Synthetically generated peptide
  misc_feature (1)..(1): Xaa can be Cys or D-Cys
  misc_feature (13)..(13): Xaa can be Cys or D-Cys
XCEFCCTPACTGXK

SEQ ID NO: 255 - protein, 14 aa, Artificial Sequence
  Synthetically generated peptide
  misc_feature (1)..(1): Xaa can be Cys or D-Cys
  misc_feature (13)..(13): Xaa can be Cys or D-Cys
XCEFCCTPACTGXY

SEQ ID NO: 256 - protein, 13 aa, Artificial Sequence
  Synthetically generated peptide
  misc_feature (1)..(1): Xaa can be Cys or D-Cys
  misc_feature (5)..(5): Xaa can be Cys or D-Cys
XCEFXCNPACTGC

SEQ ID NO: 257 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
XCEFXCNPACTGCK

SEQ ID NO: 258 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
XCEFXCNPACTGCY

SEQ ID NO: 259 - protein, 13 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCEFXCNPACTGX

SEQ ID NO: 260 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCEFXCNPACTGXK

SEQ ID NO: 261 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCEFXCNPACTGXY

SEQ ID NO: 262 - protein, 13 aa, Artificial Sequence
  Synthetically generated peptide
  misc_feature (1)..(1): Xaa can be Cys or D-Cys
  misc_feature (5)..(5): Xaa can be Cys or D-Cys
XCEFXCTPACTGC

SEQ ID NO: 263 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
XCEFXCTPACTGCK

SEQ ID NO: 264 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
XCEFXCTPACTGCY

SEQ ID NO: 265 - protein, 13 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCEFXCTPACTGX

SEQ ID NO: 266 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCEFXCTPACTGXK

SEQ ID NO: 267 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCEFXCTPACTGXY

SEQ ID NO: 268 - protein, 13 aa, Artificial Sequence
  Synthetically generated peptide
  misc_feature (1)..(1): Xaa can be Cys or D-Cys
XCEWCCNPACTGC

SEQ ID NO: 269 - protein, 14 aa, Artificial Sequence
  Synthetically generated peptide
  misc_feature (1)..(1): Xaa can be Cys or D-Cys
XCEWCCNPACTGCK

SEQ ID NO: 270 - protein, 14 aa, Artificial Sequence
  Synthetically generated peptide
  misc_feature (1)..(1): Xaa can be Cys or D-Cys
XCEWCCNPACTGCY

SEQ ID NO: 271 - protein, 13 aa, Artificial Sequence
  Synthetically generated peptide
  misc_feature (1)..(1): Xaa can be Cys or D-Cys
  misc_feature (13)..(13): Xaa can be Cys or D-Cys
XCEWCCNPACTGX

SEQ ID NO: 272 - protein, 14 aa, Artificial Sequence
  Synthetically generated peptide
  misc_feature (1)..(1): Xaa can be Cys or D-Cys
  misc_feature (13)..(13): Xaa can be Cys or D-Cys
XCEWCCNPACTGXK

SEQ ID NO: 273 - protein, 14 aa, Artificial Sequence
  Synthetically generated peptide
  misc_feature (1)..(1): Xaa can be Cys or D-Cys
  misc_feature (13)..(13): Xaa can be Cys or D-Cys
XCEWCCNPACTGXY

SEQ ID NO: 274 - protein, 13 aa, Artificial Sequence
  Synthetically generated peptide
  misc_feature (1)..(1): Xaa can be Cys or D-Cys
XCEWCCTPACTGC

SEQ ID NO: 275 - protein, 14 aa, Artificial Sequence
  Synthetically generated peptide
  misc_feature (1)..(1): Xaa can be Cys or D-Cys
XCEWCCTPACTGCK

SEQ ID NO: 276 - protein, 14 aa, Artificial Sequence
  Synthetically generated peptide
  misc_feature (1)..(1): Xaa can be Cys or D-Cys
XCEWCCTPACTGCY

SEQ ID NO: 277 - protein, 13 aa, Artificial Sequence
  Synthetically generated peptide
  misc_feature (1)..(1): Xaa can be Cys or D-Cys
  misc_feature (13)..(13): Xaa can be Cys or D-Cys
XCEWCCTPACTGX

SEQ ID NO: 278 - protein, 14 aa, Artificial Sequence
  Synthetically generated peptide
  misc_feature (1)..(1): Xaa can be Cys or D-Cys
  misc_feature (13)..(13): Xaa can be Cys or D-Cys
XCEWCCTPACTGXK

SEQ ID NO: 279 - protein, 14 aa, Artificial Sequence
  Synthetically generated peptide
  misc_feature (1)..(1): Xaa can be Cys or D-Cys
  misc_feature (13)..(13): Xaa can be Cys or D-Cys
XCEWCCTPACTGXY

SEQ ID NO: 280 - protein, 13 aa, Artificial Sequence
  Synthetically generated peptide
  misc_feature (1)..(1): Xaa can be Cys or D-Cys
  misc_feature (5)..(5): Xaa can be Cys or D-Cys
XCEWXCNPACTGC

SEQ ID NO: 281 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
XCEWXCNPACTGCK

SEQ ID NO: 282 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
XCEWXCNPACTGCY

SEQ ID NO: 283 - protein, 13 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCEWXCNPACTGX

SEQ ID NO: 284 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCEWXCNPACTGXK

SEQ ID NO: 285 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCEWXCNPACTGXY

SEQ ID NO: 286 - protein, 13 aa, Artificial Sequence
  Synthetically generated peptide
  misc_feature (1)..(1): Xaa can be Cys or D-Cys
  misc_feature (5)..(5): Xaa can be Cys or D-Cys
XCEWXCTPACTGC

SEQ ID NO: 287 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
XCEWXCTPACTGCK

SEQ ID NO: 288 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
XCEWXCTPACTGCY

SEQ ID NO: 289 - protein, 13 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCEWXCTPACTGX

SEQ ID NO: 290 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCEWXCTPACTGXK

SEQ ID NO: 291 - protein, 14 aa, Artificial Sequence
  Synthetically generated peptide
  misc_feature (1)..(1): Xaa can be Cys or D-Cys
  misc_feature (5)..(5): Xaa can be Cys or D-Cys
  misc_feature (13)..(13): Xaa can be Cys or D-Cys
XCEWXCTPACTGXY

SEQ ID NO: 292 - protein, 14 aa, Artificial Sequence
  Synthetically generated peptide
ACCEVCCNPACTGC

SEQ ID NO: 293 - protein, 15 aa, Artificial Sequence
  Synthetically generated peptide
ACCEVCCNPACTGCK

SEQ ID NO: 294 - protein, 15 aa, Artificial Sequence
  Synthetically generated peptide
ACCEVCCNPACTGCY

SEQ ID NO: 295 - protein, 14 aa, Artificial Sequence
  Synthetically generated peptide
  misc_feature (14)..(14): Xaa can be Cys or D-Cys
ACCEVCCNPACTGX

SEQ ID NO: 296 - protein, 15 aa, Artificial Sequence
  Synthetically generated peptide
  misc_feature (14)..(14): Xaa can be Cys or D-Cys
ACCEVCCNPACTGXK

SEQ ID NO: 297 - protein, 15 aa, Artificial Sequence
  Synthetically generated peptide
  misc_feature (14)..(14): Xaa can be Cys or D-Cys
ACCEVCCNPACTGXY

SEQ ID NO: 298 - protein, 14 aa, Artificial Sequence
  Synthetically generated peptide
ACCEVCCTPACTGC

SEQ ID NO: 299 - protein, 15 aa, Artificial Sequence
  Synthetically generated peptide
ACCEVCCTPACTGCK

SEQ ID NO: 300 - protein, 15 aa, Artificial Sequence
  Synthetically generated peptide
ACCEVCCTPACTGCY

SEQ ID NO: 301 - protein, 14 aa, Artificial Sequence
  Synthetically generated peptide
  misc_feature (14)..(14): Xaa can be Cys or D-Cys
ACCEVCCTPACTGX

SEQ ID NO: 302 - protein, 15 aa, Artificial Sequence
  Synthetically generated peptide
  misc_feature (14)..(14): Xaa can be Cys or D-Cys
ACCEVCCTPACTGXK

SEQ ID NO: 303 - protein, 15 aa, Artificial Sequence
  Synthetically generated peptide
  misc_feature (14)..(14): Xaa can be Cys or D-Cys
ACCEVCCTPACTGXY

SEQ ID NO: 304 - protein, 14 aa, Artificial Sequence
  Synthetically generated peptide
  misc_feature (6)..(6): Xaa can be Cys or D-Cys
ACCEVXCNPACTGC

SEQ ID NO: 305 - protein, 15 aa, Artificial Sequence
  Synthetically generated peptide
  misc_feature (6)..(6): Xaa can be Cys or D-Cys
ACCEVXCNPACTGCK

SEQ ID NO: 306 - protein, 15 aa, Artificial Sequence
  Synthetically generated peptide
  misc_feature (6)..(6): Xaa can be Cys or D-Cys
ACCEVXCNPACTGCY

SEQ ID NO: 307 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
ACCEVXCNPACTGX

SEQ ID NO: 308 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEVXCNPACTGXK

SEQ ID NO: 309 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEVXCNPACTGXY

SEQ ID NO: 310 - protein, 14 aa, Artificial Sequence
  Synthetically generated peptide
  misc_feature (6)..(6): Xaa can be Cys or D-Cys
ACCEVXCTPACTGC

SEQ ID NO: 311 - protein, 15 aa, Artificial Sequence
  Synthetically generated peptide
  misc_feature (6)..(6): Xaa can be Cys or D-Cys
ACCEVXCTPACTGCK

SEQ ID NO: 312 - protein, 15 aa, Artificial Sequence
  Synthetically generated peptide
  misc_feature (6)..(6): Xaa can be Cys or D-Cys
ACCEVXCTPACTGCY

SEQ ID NO: 313 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
ACCEVXCTPACTGX

SEQ ID NO: 314 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEVXCTPACTGXK

SEQ ID NO: 315 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEVXCTPACTGXY

SEQ ID NO: 316 - protein, 14 aa, Artificial Sequence
  Synthetically generated peptide
ACCEICCNPACTGC

SEQ ID NO: 317 - protein, 15 aa, Artificial Sequence
  Synthetically generated peptide
ACCEICCNPACTGCK

SEQ ID NO: 318 - protein, 15 aa, Artificial Sequence
  Synthetically generated peptide
ACCEICCNPACTGCY

SEQ ID NO: 319 - protein, 14 aa, Artificial Sequence
  Synthetically generated peptide
  misc_feature (14)..(14): Xaa can be Cys or D-Cys
ACCEICCNPACTGX

SEQ ID NO: 320 - protein, 15 aa, Artificial Sequence
  Synthetically generated peptide
  misc_feature (14)..(14): Xaa can be Cys or D-Cys
ACCEICCNPACTGXK

SEQ ID NO: 321 - protein, 15 aa, Artificial Sequence
  Synthetically generated peptide
  misc_feature (14)..(14): Xaa can be Cys or D-Cys
ACCEICCNPACTGXY

SEQ ID NO: 322 - protein, 14 aa, Artificial Sequence
  Synthetically generated peptide
ACCEICCTPACTGC

SEQ ID NO: 323 - protein, 15 aa, Artificial Sequence
  Synthetically generated peptide
ACCEICCTPACTGCK

SEQ ID NO: 324 - protein, 15 aa, Artificial Sequence
  Synthetically generated peptide
ACCEICCTPACTGCY

SEQ ID NO: 325 - protein, 14 aa, Artificial Sequence
  Synthetically generated peptide
  misc_feature (14)..(14): Xaa can be Cys or D-Cys
ACCEICCTPACTGX

SEQ ID NO: 326 - protein, 15 aa, Artificial Sequence
  Synthetically generated peptide
  misc_feature (14)..(14): Xaa can be Cys or D-Cys
ACCEICCTPACTGXK

SEQ ID NO: 327 - protein, 15 aa, Artificial Sequence
  Synthetically generated peptide
  misc_feature (14)..(14): Xaa can be Cys or D-Cys
ACCEICCTPACTGXY

SEQ ID NO: 328 - protein, 14 aa, Artificial Sequence
  Synthetically generated peptide
  misc_feature (6)..(6): Xaa can be Cys or D-Cys
ACCEIXCNPACTGC

SEQ ID NO: 329 - protein, 15 aa, Artificial Sequence
  Synthetically generated peptide
  misc_feature (6)..(6): Xaa can be Cys or D-Cys
ACCEIXCNPACTGCK

SEQ ID NO: 330 - protein, 15 aa, Artificial Sequence
  Synthetically generated peptide
  misc_feature (6)..(6): Xaa can be Cys or D-Cys
ACCEIXCNPACTGCY

SEQ ID NO: 331 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
ACCEIXCNPACTGX

SEQ ID NO: 332 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEIXCNPACTGXK

SEQ ID NO: 333 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEIXCNPACTGXY

SEQ ID NO: 334 - protein, 14 aa, Artificial Sequence
  Synthetically generated peptide
  misc_feature (6)..(6): Xaa can be Cys or D-Cys
ACCEIXCTPACTGC

SEQ ID NO: 335 - protein, 15 aa, Artificial Sequence
  Synthetically generated peptide
  misc_feature (6)..(6): Xaa can be Cys or D-Cys
ACCEIXCTPACTGCK

SEQ ID NO: 336 - protein, 15 aa, Artificial Sequence
  Synthetically generated peptide
  misc_feature (6)..(6): Xaa can be Cys or D-Cys
ACCEIXCTPACTGCY

SEQ ID NO: 337 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
ACCEIXCTPACTGX

SEQ ID NO: 338 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEIXCTPACTGXK

SEQ ID NO: 339 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEIXCTPACTGXY

SEQ ID NO: 340 - protein, 14 aa, Artificial Sequence
  Synthetically generated peptide
ACCELCCNPACTGC

SEQ ID NO: 341 - protein, 15 aa, Artificial Sequence
  Synthetically generated peptide
ACCELCCNPACTGCK

SEQ ID NO: 342 - protein, 15 aa, Artificial Sequence
  Synthetically generated peptide
ACCELCCNPACTGCY

SEQ ID NO: 343 - protein, 14 aa, Artificial Sequence
  Synthetically generated peptide
  misc_feature (14)..(14): Xaa can be Cys or D-Cys
ACCELCCNPACTGX

SEQ ID NO: 344 - protein, 15 aa, Artificial Sequence
  Synthetically generated peptide
  misc_feature (14)..(14): Xaa can be Cys or D-Cys
ACCELCCNPACTGXK

SEQ ID NO: 345 - protein, 15 aa, Artificial Sequence
  Synthetically generated peptide
  misc_feature (14)..(14): Xaa can be Cys or D-Cys
ACCELCCNPACTGXY

SEQ ID NO: 346 - protein, 14 aa, Artificial Sequence
  Synthetically generated peptide
ACCELCCTPACTGC

SEQ ID NO: 347 - protein, 15 aa, Artificial Sequence
  Synthetically generated peptide
ACCELCCTPACTGCK

SEQ ID NO: 348 - protein, 15 aa, Artificial Sequence
  Synthetically generated peptide
ACCELCCTPACTGCY

SEQ ID NO: 349 - protein, 14 aa, Artificial Sequence
  Synthetically generated peptide
  misc_feature (14)..(14): Xaa can be Cys or D-Cys
ACCELCCTPACTGX

SEQ ID NO: 350 - protein, 15 aa, Artificial Sequence
  Synthetically generated peptide
  misc_feature (14)..(14): Xaa can be Cys or D-Cys
ACCELCCTPACTGXK

SEQ ID NO: 351 - protein, 15 aa, Artificial Sequence
  Synthetically generated peptide
  misc_feature (14)..(14): Xaa can be Cys or D-Cys
ACCELCCTPACTGXY

SEQ ID NO: 352 - protein, 14 aa, Artificial Sequence
  Synthetically generated peptide
  misc_feature (6)..(6): Xaa can be Cys or D-Cys
ACCELXCNPACTGC

SEQ ID NO: 353 - protein, 15 aa, Artificial Sequence
  Synthetically generated peptide
  misc_feature (6)..(6): Xaa can be Cys or D-Cys
ACCELXCNPACTGCK

SEQ ID NO: 354 - protein, 15 aa, Artificial Sequence
  Synthetically generated peptide
  misc_feature (6)..(6): Xaa can be Cys or D-Cys
ACCELXCNPACTGCY

SEQ ID NO: 355 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
ACCELXCNPACTGX

SEQ ID NO: 356 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCELXCNPACTGXK

SEQ ID NO: 357 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCELXCNPACTGXY

SEQ ID NO: 358 - protein, 14 aa, Artificial Sequence
  Synthetically generated peptide
  misc_feature (6)..(6): Xaa can be Cys or D-Cys
ACCELXCTPACTGC

SEQ ID NO: 359 - protein, 15 aa, Artificial Sequence
  Synthetically generated peptide
  misc_feature (6)..(6): Xaa can be Cys or D-Cys
ACCELXCTPACTGCK

SEQ ID NO: 360 - protein, 15 aa, Artificial Sequence
  Synthetically generated peptide
  misc_feature (6)..(6): Xaa can be Cys or D-Cys
ACCELXCTPACTGCY

SEQ ID NO: 361 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
ACCELXCTPACTGX

SEQ ID NO: 362 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCELXCTPACTGXK

SEQ ID NO: 363 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCELXCTPACTGXY

SEQ ID NO: 364 - protein, 14 aa, Artificial Sequence
  Synthetically generated peptide
ACCEYCCNPACTGC

SEQ ID NO: 365 - protein, 15 aa, Artificial Sequence
  Synthetically generated peptide
ACCEYCCNPACTGCK

SEQ ID NO: 366 - protein, 15 aa, Artificial Sequence
  Synthetically generated peptide
ACCEYCCNPACTGCY

SEQ ID NO: 367 - protein, 14 aa, Artificial Sequence
  Synthetically generated peptide
  misc_feature (14)..(14): Xaa can be Cys or D-Cys
ACCEYCCNPACTGX

SEQ ID NO: 368 - protein, 15 aa, Artificial Sequence
  Synthetically generated peptide
  misc_feature (14)..(14): Xaa can be Cys or D-Cys
ACCEYCCNPACTGXK

SEQ ID NO: 369 - protein, 15 aa, Artificial Sequence
  Synthetically generated peptide
  misc_feature (14)..(14): Xaa can be Cys or D-Cys
ACCEYCCNPACTGXY

SEQ ID NO: 370 - protein, 14 aa, Artificial Sequence
  Synthetically generated peptide
ACCEYCCTPACTGC

SEQ ID NO: 371 - protein, 15 aa, Artificial Sequence
  Synthetically generated peptide
ACCEYCCTPACTGCK

SEQ ID NO: 372 - protein, 15 aa, Artificial Sequence
  Synthetically generated peptide
ACCEYCCTPACTGCY

SEQ ID NO: 373 - protein, 14 aa, Artificial Sequence
  Synthetically generated peptide
  misc_feature (14)..(14): Xaa can be Cys or D-Cys
ACCEYCCTPACTGX

SEQ ID NO: 374 - protein, 15 aa, Artificial Sequence
  Synthetically generated peptide
  misc_feature (14)..(14): Xaa can be Cys or D-Cys
ACCEYCCTPACTGXK

SEQ ID NO: 375 - protein, 15 aa, Artificial Sequence
  Synthetically generated peptide
  misc_feature (14)..(14): Xaa can be Cys or D-Cys
ACCEYCCTPACTGXY

SEQ ID NO: 376 - protein, 14 aa, Artificial Sequence
  Synthetically generated peptide
  misc_feature (6)..(6): Xaa can be Cys or D-Cys
ACCEYXCNPACTGC

SEQ ID NO: 377 - protein, 15 aa, Artificial Sequence
  Synthetically generated peptide
  misc_feature (6)..(6): Xaa can be Cys or D-Cys
ACCEYXCNPACTGCK

SEQ ID NO: 378 - protein, 15 aa, Artificial Sequence
  Synthetically generated peptide
  misc_feature (6)..(6): Xaa can be Cys or D-Cys
ACCEYXCNPACTGCY

SEQ ID NO: 379 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
ACCEYXCNPACTGX

SEQ ID NO: 380 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEYXCNPACTGXK

SEQ ID NO: 381 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEYXCNPACTGXY

SEQ ID NO: 382 - protein, 14 aa, Artificial Sequence
  Synthetically generated peptide
  misc_feature (6)..(6): Xaa can be Cys or D-Cys
ACCEYXCTPACTGC

SEQ ID NO: 383 - protein, 15 aa, Artificial Sequence
  Synthetically generated peptide
  misc_feature (6)..(6): Xaa can be Cys or D-Cys
ACCEYXCTPACTGCK

SEQ ID NO: 384 - protein, 15 aa, Artificial Sequence
  Synthetically generated peptide
  misc_feature (6)..(6): Xaa can be Cys or D-Cys
ACCEYXCTPACTGCY

SEQ ID NO: 385 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
ACCEYXCTPACTGX

SEQ ID NO: 386 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEYXCTPACTGXK

SEQ ID NO: 387 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEYXCTPACTGXY

SEQ ID NO: 388 - protein, 14 aa, Artificial Sequence
  Synthetically generated peptide
ACCEFCCNPACTGC

SEQ ID NO: 389 - protein, 15 aa, Artificial Sequence
  Synthetically generated peptide
ACCEFCCNPACTGCK

SEQ ID NO: 390 - protein, 15 aa, Artificial Sequence
  Synthetically generated peptide
ACCEFCCNPACTGCY

SEQ ID NO: 391 - protein, 14 aa, Artificial Sequence
  Synthetically generated peptide
  misc_feature (14)..(14): Xaa can be Cys or D-Cys
ACCEFCCNPACTGX

SEQ ID NO: 392 - protein, 15 aa, Artificial Sequence
  Synthetically generated peptide
  misc_feature (14)..(14): Xaa can be Cys or D-Cys
ACCEFCCNPACTGXK

SEQ ID NO: 393 - protein, 15 aa, Artificial Sequence
  Synthetically generated peptide
  misc_feature (14)..(14): Xaa can be Cys or D-Cys
ACCEFCCNPACTGXY

SEQ ID NO: 394 - protein, 14 aa, Artificial Sequence
  Synthetically generated peptide
ACCEFCCTPACTGC

SEQ ID NO: 395 - protein, 15 aa, Artificial Sequence
  Synthetically generated peptide
ACCEFCCTPACTGCK

SEQ ID NO: 396 - protein, 15 aa, Artificial Sequence
  Synthetically generated peptide
ACCEFCCTPACTGCY

SEQ ID NO: 397 - protein, 14 aa, Artificial Sequence
  Synthetically generated peptide
  misc_feature (14)..(14): Xaa can be Cys or D-Cys
ACCEFCCTPACTGX

SEQ ID NO: 398 - protein, 15 aa, Artificial Sequence
  Synthetically generated peptide
  misc_feature (14)..(14): Xaa can be Cys or D-Cys
ACCEFCCTPACTGXK

SEQ ID NO: 399 - protein, 15 aa, Artificial Sequence
  Synthetically generated peptide
  misc_feature (14)..(14): Xaa can be Cys or D-Cys
ACCEFCCTPACTGXY

SEQ ID NO: 400 - protein, 14 aa, Artificial Sequence
  Synthetically generated peptide
  misc_feature (6)..(6): Xaa can be Cys or D-Cys
ACCEFXCNPACTGC

SEQ ID NO: 401 - protein, 15 aa, Artificial Sequence
  Synthetically generated peptide
  misc_feature (6)..(6): Xaa can be Cys or D-Cys
ACCEFXCNPACTGCK

SEQ ID NO: 402 - protein, 15 aa, Artificial Sequence
  Synthetically generated peptide
  misc_feature (6)..(6): Xaa can be Cys or D-Cys
ACCEFXCNPACTGCY

SEQ ID NO: 403 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
ACCEFXCNPACTGX

SEQ ID NO: 404 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEFXCNPACTGXK

SEQ ID NO: 405 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEFXCNPACTGXY

SEQ ID NO: 406 - protein, 14 aa, Artificial Sequence
  Synthetically generated peptide
  misc_feature (6)..(6): Xaa can be Cys or D-Cys
ACCEFXCTPACTGC

SEQ ID NO: 407 - protein, 15 aa, Artificial Sequence
  Synthetically generated peptide
  misc_feature (6)..(6): Xaa can be Cys or D-Cys
ACCEFXCTPACTGCK

SEQ ID NO: 408 - protein, 15 aa, Artificial Sequence
  Synthetically generated peptide
  misc_feature (6)..(6): Xaa can be Cys or D-Cys
ACCEFXCTPACTGCY

SEQ ID NO: 409 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
ACCEFXCTPACTGX

SEQ ID NO: 410 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEFXCTPACTGXK

SEQ ID NO: 411 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEFXCTPACTGXY

SEQ ID NO: 412 - protein, 14 aa, Artificial Sequence
  Synthetically generated peptide
ACCEWCCNPACTGC

SEQ ID NO: 413 - protein, 15 aa, Artificial Sequence
  Synthetically generated peptide
ACCEWCCNPACTGCK

SEQ ID NO: 414 - protein, 15 aa, Artificial Sequence
  Synthetically generated peptide
ACCEWCCNPACTGCY

SEQ ID NO: 415 - protein, 14 aa, Artificial Sequence
  Synthetically generated peptide
  misc_feature (14)..(14): Xaa can be Cys or D-Cys
ACCEWCCNPACTGX

SEQ ID NO: 416 - protein, 15 aa, Artificial Sequence
  Synthetically generated peptide
  misc_feature (14)..(14): Xaa can be Cys or D-Cys
ACCEWCCNPACTGXK

SEQ ID NO: 417 - protein, 15 aa, Artificial Sequence
  Synthetically generated peptide
  misc_feature (14)..(14): Xaa can be Cys or D-Cys
ACCEWCCNPACTGXY

SEQ ID NO: 418 - protein, 14 aa, Artificial Sequence
  Synthetically generated peptide
ACCEWCCTPACTGC

SEQ ID NO: 419 - protein, 15 aa, Artificial Sequence
  Synthetically generated peptide
ACCEWCCTPACTGCK

SEQ ID NO: 420 - protein, 15 aa, Artificial Sequence
  Synthetically generated peptide
ACCEWCCTPACTGCY

SEQ ID NO: 421 - protein, 14 aa, Artificial Sequence
  Synthetically generated peptide
  misc_feature (14)..(14): Xaa can be Cys or D-Cys
ACCEWCCTPACTGX

SEQ ID NO: 422 - protein, 15 aa, Artificial Sequence
  Synthetically generated peptide
  misc_feature (14)..(14): Xaa can be Cys or D-Cys
ACCEWCCTPACTGXK

SEQ ID NO: 423 - protein, 15 aa, Artificial Sequence
  Synthetically generated peptide
  misc_feature (14)..(14): Xaa can be Cys or D-Cys
ACCEWCCTPACTGXY

SEQ ID NO: 424 - protein, 14 aa, Artificial Sequence
  Synthetically generated peptide
  misc_feature (6)..(6): Xaa can be Cys or D-Cys
ACCEWXCNPACTGC

SEQ ID NO: 425 - protein, 15 aa, Artificial Sequence
  Synthetically generated peptide
  misc_feature (6)..(6): Xaa can be Cys or D-Cys
ACCEWXCNPACTGCK

SEQ ID NO: 426 - protein, 15 aa, Artificial Sequence
  Synthetically generated peptide
  misc_feature (6)..(6): Xaa can be Cys or D-Cys
ACCEWXCNPACTGCY

SEQ ID NO: 427 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
ACCEWXCNPACTGX

SEQ ID NO: 428 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEWXCNPACTGXK

SEQ ID NO: 429 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEWXCNPACTGXY

SEQ ID NO: 430 - protein, 14 aa, Artificial Sequence
  Synthetically generated peptide
  misc_feature (6)..(6): Xaa can be Cys or D-Cys
ACCEWXCTPACTGC

SEQ ID NO: 431 - protein, 15 aa, Artificial Sequence
  Synthetically generated peptide
  misc_feature (6)..(6): Xaa can be Cys or D-Cys
ACCEWXCTPACTGCK

SEQ ID NO: 432 - protein, 15 aa, Artificial Sequence
  Synthetically generated peptide
  misc_feature (6)..(6): Xaa can be Cys or D-Cys
ACCEWXCTPACTGCY

SEQ ID NO: 433 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
ACCEWXCTPACTGX

SEQ ID NO: 434 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEWXCTPACTGXK

SEQ ID NO: 435 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEWXCTPACTGXY

SEQ ID NO: 436 - protein, 14 aa, Artificial Sequence
  Synthetically generated peptide
  misc_feature (2)..(2): Xaa can be Cys or D-Cys
AXCEVCCNPACTGC

SEQ ID NO: 437 - protein, 15 aa, Artificial Sequence
  Synthetically generated peptide
  misc_feature (2)..(2): Xaa can be Cys or D-Cys
AXCEVCCNPACTGCK

SEQ ID NO: 438 - protein, 15 aa, Artificial Sequence
  Synthetically generated peptide
  misc_feature (2)..(2): Xaa can be Cys or D-Cys
AXCEVCCNPACTGCY

SEQ ID NO: 439 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
AXCEVCCNPACTGX

SEQ ID NO: 440 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEVCCNPACTGXK

SEQ ID NO: 441 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEVCCNPACTGXY

SEQ ID NO: 442 - protein, 14 aa, Artificial Sequence
  Synthetically generated peptide
  misc_feature (2)..(2): Xaa can be Cys or D-Cys
AXCEVCCTPACTGC

SEQ ID NO: 443 - protein, 15 aa, Artificial Sequence
  Synthetically generated peptide
  misc_feature (2)..(2): Xaa can be Cys or D-Cys
AXCEVCCTPACTGCK

SEQ ID NO: 444 - protein, 15 aa, Artificial Sequence
  Synthetically generated peptide
  misc_feature (2)..(2): Xaa can be Cys or D-Cys
AXCEVCCTPACTGCY

SEQ ID NO: 445 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
AXCEVCCTPACTGX

SEQ ID NO: 446 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEVCCTPACTGXK

SEQ ID NO: 447 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEVCCTPACTGXY

SEQ ID NO: 448 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
AXCEVXCNPACTGC

SEQ ID NO: 449 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEVXCNPACTGCK

SEQ ID NO: 450 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEVXCNPACTGCY

SEQ ID NO: 451 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEVXCNPACTGX

SEQ ID NO: 452 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEVXCNPACTGXK

SEQ ID NO: 453 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEVXCNPACTGXY

SEQ ID NO: 454 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
AXCEVXCTPACTGC

SEQ ID NO: 455 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEVXCTPACTGCK

SEQ ID NO: 456 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEVXCTPACTGCY

SEQ ID NO: 457 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEVXCTPACTGX

SEQ ID NO: 458 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEVXCTPACTGXK

SEQ ID NO: 459 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEVXCTPACTGXY

SEQ ID NO: 460 - protein, 14 aa, Artificial Sequence
  Synthetically generated peptide
  misc_feature (2)..(2): Xaa can be Cys or D-Cys
AXCEICCNPACTGC

SEQ ID NO: 461 - protein, 15 aa, Artificial Sequence
  Synthetically generated peptide
  misc_feature (2)..(2): Xaa can be Cys or D-Cys
AXCEICCNPACTGCK

SEQ ID NO: 462 - protein, 15 aa, Artificial Sequence
  Synthetically generated peptide
  misc_feature (2)..(2): Xaa can be Cys or D-Cys
AXCEICCNPACTGCY

SEQ ID NO: 463 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
AXCEICCNPACTGX

SEQ ID NO: 464 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEICCNPACTGXK

SEQ ID NO: 465 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEICCNPACTGXY

SEQ ID NO: 466 - protein, 14 aa, Artificial Sequence
  Synthetically generated peptide
  misc_feature (2)..(2): Xaa can be Cys or D-Cys
AXCEICCTPACTGC

SEQ ID NO: 467 - protein, 15 aa, Artificial Sequence
  Synthetically generated peptide
  misc_feature (2)..(2): Xaa can be Cys or D-Cys
AXCEICCTPACTGCK

SEQ ID NO: 468 - protein, 15 aa, Artificial Sequence
  Synthetically generated peptide
  misc_feature (2)..(2): Xaa can be Cys or D-Cys
AXCEICCTPACTGCY

SEQ ID NO: 469 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
AXCEICCTPACTGX

SEQ ID NO: 470 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEICCTPACTGXK

SEQ ID NO: 471 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEICCTPACTGXY

SEQ ID NO: 472 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
AXCEIXCNPACTGC

SEQ ID NO: 473 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEIXCNPACTGCK

SEQ ID NO: 474 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEIXCNPACTGCY

SEQ ID NO: 475 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEIXCNPACTGX

SEQ ID NO: 476 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEIXCNPACTGXK

SEQ ID NO: 477 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEIXCNPACTGXY

SEQ ID NO: 478 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
AXCEIXCTPACTGC

SEQ ID NO: 479 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEIXCTPACTGCK

SEQ ID NO: 480 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEIXCTPACTGCY

SEQ ID NO: 481 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEIXCTPACTGX

SEQ ID NO: 482 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEIXCTPACTGXK

SEQ ID NO: 483 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEIXCTPACTGXY

SEQ ID NO: 484 - protein, 14 aa, Artificial Sequence
  Synthetically generated peptide
  misc_feature (2)..(2): Xaa can be Cys or D-Cys
AXCELCCNPACTGC

SEQ ID NO: 485 - protein, 15 aa, Artificial Sequence
  Synthetically generated peptide
  misc_feature (2)..(2): Xaa can be Cys or D-Cys
AXCELCCNPACTGCK

SEQ ID NO: 486 - protein, 15 aa, Artificial Sequence
  Synthetically generated peptide
  misc_feature (2)..(2): Xaa can be Cys or D-Cys
AXCELCCNPACTGCY

SEQ ID NO: 487 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
AXCELCCNPACTGX

SEQ ID NO: 488 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCELCCNPACTGXK

SEQ ID NO: 489 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCELCCNPACTGXY

SEQ ID NO: 490 - protein, 14 aa, Artificial Sequence
  Synthetically generated peptide
  misc_feature (2)..(2): Xaa can be Cys or D-Cys
AXCELCCTPACTGC

SEQ ID NO: 491 - protein, 15 aa, Artificial Sequence
  Synthetically generated peptide
  misc_feature (2)..(2): Xaa can be Cys or D-Cys
AXCELCCTPACTGCK

SEQ ID NO: 492 - protein, 15 aa, Artificial Sequence
  Synthetically generated peptide
  misc_feature (2)..(2): Xaa can be Cys or D-Cys
AXCELCCTPACTGCY

SEQ ID NO: 493 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
AXCELCCTPACTGX

SEQ ID NO: 494 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCELCCTPACTGXK

SEQ ID NO: 495 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCELCCTPACTGXY

SEQ ID NO: 496 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
AXCELXCNPACTGC

SEQ ID NO: 497 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCELXCNPACTGCK

SEQ ID NO: 498 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCELXCNPACTGCY

SEQ ID NO: 499 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCELXCNPACTGX

SEQ ID NO: 500 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCELXCNPACTGXK

SEQ ID NO: 501 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCELXCNPACTGXY

SEQ ID NO: 502 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
AXCELXCTPACTGC

SEQ ID NO: 503 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCELXCTPACTGCK

SEQ ID NO: 504 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCELXCTPACTGCY

SEQ ID NO: 505 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCELXCTPACTGX

SEQ ID NO: 506 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCELXCTPACTGXK

SEQ ID NO: 507 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCELXCTPACTGXY

SEQ ID NO: 508 - protein, 14 aa, Artificial Sequence
  Synthetically generated peptide
  misc_feature (2)..(2): Xaa can be Cys or D-Cys
AXCEYCCNPACTGC

SEQ ID NO: 509 - protein, 15 aa, Artificial Sequence
  Synthetically generated peptide
  misc_feature (2)..(2): Xaa can be Cys or D-Cys
AXCEYCCNPACTGCK

SEQ ID NO: 510 - protein, 15 aa, Artificial Sequence
  Synthetically generated peptide
  misc_feature (2)..(2): Xaa can be Cys or D-Cys
AXCEYCCNPACTGCY

SEQ ID NO: 511 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
AXCEYCCNPACTGX

SEQ ID NO: 512 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEYCCNPACTGXK

SEQ ID NO: 513 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEYCCNPACTGXY

SEQ ID NO: 514 - protein, 14 aa, Artificial Sequence
  Synthetically generated peptide
  misc_feature (2)..(2): Xaa can be Cys or D-Cys
AXCEYCCTPACTGC

SEQ ID NO: 515 - protein, 15 aa, Artificial Sequence
  Synthetically generated peptide
  misc_feature (2)..(2): Xaa can be Cys or D-Cys
AXCEYCCTPACTGCK

SEQ ID NO: 516 - protein, 15 aa, Artificial Sequence
  Synthetically generated peptide
  misc_feature (2)..(2): Xaa can be Cys or D-Cys
AXCEYCCTPACTGCY

SEQ ID NO: 517 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
AXCEYCCTPACTGX

SEQ ID NO: 518 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEYCCTPACTGXK

SEQ ID NO: 519 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEYCCTPACTGXY

SEQ ID NO: 520 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
AXCEYXCNPACTGC

SEQ ID NO: 521 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEYXCNPACTGCK

SEQ ID NO: 522 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEYXCNPACTGCY

SEQ ID NO: 523 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEYXCNPACTGX

SEQ ID NO: 524 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEYXCNPACTGXK

SEQ ID NO: 525 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEYXCNPACTGXY

SEQ ID NO: 526 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
AXCEYXCTPACTGC

SEQ ID NO: 527 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEYXCTPACTGCK

SEQ ID NO: 528 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEYXCTPACTGCY

SEQ ID NO: 529 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEYXCTPACTGX

SEQ ID NO: 530 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEYXCTPACTGXK

SEQ ID NO: 531 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEYXCTPACTGXY

SEQ ID NO: 532 - protein, 14 aa, Artificial Sequence
  Synthetically generated peptide
  misc_feature (2)..(2): Xaa can be Cys or D-Cys
AXCEFCCNPACTGC

SEQ ID NO: 533 - protein, 15 aa, Artificial Sequence
  Synthetically generated peptide
  misc_feature (2)..(2): Xaa can be Cys or D-Cys
AXCEFCCNPACTGCK

SEQ ID NO: 534 - protein, 15 aa, Artificial Sequence
  Synthetically generated peptide
  misc_feature (2)..(2): Xaa can be Cys or D-Cys
AXCEFCCNPACTGCY

SEQ ID NO: 535 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
AXCEFCCNPACTGX

SEQ ID NO: 536 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEFCCNPACTGXK

SEQ ID NO: 537 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEFCCNPACTGXY

SEQ ID NO: 538 - protein, 14 aa, Artificial Sequence
  Synthetically generated peptide
  misc_feature (2)..(2): Xaa can be Cys or D-Cys
AXCEFCCTPACTGC

SEQ ID NO: 539 - protein, 15 aa, Artificial Sequence
  Synthetically generated peptide
  misc_feature (2)..(2): Xaa can be Cys or D-Cys
AXCEFCCTPACTGCK

SEQ ID NO: 540 - protein, 15 aa, Artificial Sequence
  Synthetically generated peptide
  misc_feature (2)..(2): Xaa can be Cys or D-Cys
AXCEFCCTPACTGCY

SEQ ID NO: 541 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
AXCEFCCTPACTGX

SEQ ID NO: 542 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEFCCTPACTGXK

SEQ ID NO: 543 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEFCCTPACTGXY

SEQ ID NO: 544 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
AXCEFXCNPACTGC

SEQ ID NO: 545 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEFXCNPACTGCK

SEQ ID NO: 546 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEFXCNPACTGCY

SEQ ID NO: 547 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEFXCNPACTGX

SEQ ID NO: 548 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEFXCNPACTGXK

SEQ ID NO: 549 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEFXCNPACTGXY

SEQ ID NO: 550 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
AXCEFXCTPACTGC

SEQ ID NO: 551 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEFXCTPACTGCK

SEQ ID NO: 552 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEFXCTPACTGCY

SEQ ID NO: 553 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEFXCTPACTGX

SEQ ID NO: 554 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEFXCTPACTGXK

SEQ ID NO: 555 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEFXCTPACTGXY

SEQ ID NO: 556 - protein, 14 aa, Artificial Sequence
  Synthetically generated peptide
  misc_feature (2)..(2): Xaa can be Cys or D-Cys
AXCEWCCNPACTGC

SEQ ID NO: 557 - protein, 15 aa, Artificial Sequence
  Synthetically generated peptide
  misc_feature (2)..(2): Xaa can be Cys or D-Cys
AXCEWCCNPACTGCK

SEQ ID NO: 558 - protein, 15 aa, Artificial Sequence
  Synthetically generated peptide
  misc_feature (2)..(2): Xaa can be Cys or D-Cys
AXCEWCCNPACTGCY

SEQ ID NO: 559 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
AXCEWCCNPACTGX

SEQ ID NO: 560 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEWCCNPACTGXK

SEQ ID NO: 561 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEWCCNPACTGXY

SEQ ID NO: 562 - protein, 14 aa, Artificial Sequence
  Synthetically generated peptide
  misc_feature (2)..(2): Xaa can be Cys or D-Cys
AXCEWCCTPACTGC

SEQ ID NO: 563 - protein, 15 aa, Artificial Sequence
  Synthetically generated peptide
  misc_feature (2)..(2): Xaa can be Cys or D-Cys
AXCEWCCTPACTGCK

SEQ ID NO: 564 - protein, 15 aa, Artificial Sequence
  Synthetically generated peptide
  misc_feature (2)..(2): Xaa can be Cys or D-Cys
AXCEWCCTPACTGCY

SEQ ID NO: 565 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
AXCEWCCTPACTGX

SEQ ID NO: 566 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEWCCTPACTGXK

SEQ ID NO: 567 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEWCCTPACTGXY

SEQ ID NO: 568 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
AXCEWXCNPACTGC

SEQ ID NO: 569 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEWXCNPACTGCK

SEQ ID NO: 570 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEWXCNPACTGCY

SEQ ID NO: 571 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEWXCNPACTGX

SEQ ID NO: 572 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEWXCNPACTGXK

SEQ ID NO: 573 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEWXCNPACTGXY

SEQ ID NO: 574 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
AXCEWXCTPACTGC

SEQ ID NO: 575 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEWXCTPACTGCK

SEQ ID NO: 576 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEWXCTPACTGCY

SEQ ID NO: 577 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEWXCTPACTGX

SEQ ID NO: 578 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEWXCTPACTGXK

SEQ ID NO: 579 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEWXCTPACTGXY

SEQ ID NO: 580 - protein, 14 aa, Artificial Sequence
  Synthetically generated peptide
GCCEVCCNPACTGC

SEQ ID NO: 581 - protein, 15 aa, Artificial Sequence
  Synthetically generated peptide
GCCEVCCNPACTGCK

SEQ ID NO: 582 - protein, 15 aa, Artificial Sequence
  Synthetically generated peptide
GCCEVCCNPACTGCY

SEQ ID NO: 583 - protein, 14 aa, Artificial Sequence
  Synthetically generated peptide
  misc_feature (14)..(14): Xaa can be Cys or D-Cys
GCCEVCCNPACTGX

SEQ ID NO: 584 - protein, 15 aa, Artificial Sequence
  Synthetically generated peptide
  misc_feature (14)..(14): Xaa can be Cys or D-Cys
GCCEVCCNPACTGXK

SEQ ID NO: 585 - protein, 15 aa, Artificial Sequence
  Synthetically generated peptide
  misc_feature (14)..(14): Xaa can be Cys or D-Cys
GCCEVCCNPACTGXY

SEQ ID NO: 586 - protein, 14 aa, Artificial Sequence
  Synthetically generated peptide
GCCEVCCTPACTGC

SEQ ID NO: 587 - protein, 15 aa, Artificial Sequence
  Synthetically generated peptide
GCCEVCCTPACTGCK

SEQ ID NO: 588 - protein, 15 aa, Artificial Sequence
  Synthetically generated peptide
GCCEVCCTPACTGCY

SEQ ID NO: 589 - protein, 14 aa, Artificial Sequence
  Synthetically generated peptide
  misc_feature (14)..(14): Xaa can be Cys or D-Cys
GCCEVCCTPACTGX

SEQ ID NO: 590 - protein, 15 aa, Artificial Sequence
  Synthetically generated peptide
  misc_feature (14)..(14): Xaa can be Cys or D-Cys
GCCEVCCTPACTGXK

SEQ ID NO: 591 - protein, 15 aa, Artificial Sequence
  Synthetically generated peptide
  misc_feature (14)..(14): Xaa can be Cys or D-Cys
GCCEVCCTPACTGXY

SEQ ID NO: 592 - protein, 14 aa, Artificial Sequence
  Synthetically generated peptide
  misc_feature (6)..(6): Xaa can be Cys or D-Cys
GCCEVXCNPACTGC

SEQ ID NO: 593 - protein, 15 aa, Artificial Sequence
  Synthetically generated peptide
  misc_feature (6)..(6): Xaa can be Cys or D-Cys
GCCEVXCNPACTGCK

SEQ ID NO: 594 - protein, 15 aa, Artificial Sequence
  Synthetically generated peptide
  misc_feature (6)..(6): Xaa can be Cys or D-Cys
GCCEVXCNPACTGCY

SEQ ID NO: 595 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
GCCEVXCNPACTGX

SEQ ID NO: 596 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
GCCEVXCNPACTGXK

SEQ ID NO: 597 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
GCCEVXCNPACTGXY

SEQ ID NO: 598 - protein, 14 aa, Artificial Sequence
  Synthetically generated peptide
  misc_feature (6)..(6): Xaa can be Cys or D-Cys
GCCEVXCTPACTGC

SEQ ID NO: 599 - protein, 15 aa, Artificial Sequence
  Synthetically generated peptide
  misc_feature (6)..(6): Xaa can be Cys or D-Cys
GCCEVXCTPACTGCK

SEQ ID NO: 600 - protein, 15 aa, Artificial Sequence
  Synthetically generated peptide
  misc_feature (6)..(6): Xaa can be Cys or D-Cys
GCCEVXCTPACTGCY

SEQ ID NO: 601 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
GCCEVXCTPACTGX

SEQ ID NO: 602 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
GCCEVXCTPACTGXK

SEQ ID NO: 603 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
GCCEVXCTPACTGXY

SEQ ID NO: 604 - protein, 14 aa, Artificial Sequence
  Synthetically generated peptide
GCCEICCNPACTGC

SEQ ID NO: 605 - protein, 15 aa, Artificial Sequence
  Synthetically generated peptide
GCCEICCNPACTGCK

SEQ ID NO: 606 - protein, 15 aa, Artificial Sequence
  Synthetically generated peptide
GCCEICCNPACTGCY

SEQ ID NO: 607 - protein, 14 aa, Artificial Sequence
  Synthetically generated peptide
  misc_feature (14)..(14): Xaa can be Cys or D-Cys
GCCEICCNPACTGX

SEQ ID NO: 608 - protein, 15 aa, Artificial Sequence
  Synthetically generated peptide
  misc_feature (14)..(14): Xaa can be Cys or D-Cys
GCCEICCNPACTGXK

SEQ ID NO: 609 - protein, 15 aa, Artificial Sequence
  Synthetically generated peptide
  misc_feature (14)..(14): Xaa can be Cys or D-Cys
GCCEICCNPACTGXY

SEQ ID NO: 610 - protein, 14 aa, Artificial Sequence
  Synthetically generated peptide
GCCEICCTPACTGC

SEQ ID NO: 611 - protein, 15 aa, Artificial Sequence
  Synthetically generated peptide
GCCEICCTPACTGCK

SEQ ID NO: 612 - protein, 15 aa, Artificial Sequence
  Synthetically generated peptide
GCCEICCTPACTGCY

SEQ ID NO: 613 - protein, 14 aa, Artificial Sequence
  Synthetically generated peptide
  misc_feature (14)..(14): Xaa can be Cys or D-Cys
GCCEICCTPACTGX

SEQ ID NO: 614 - protein, 15 aa, Artificial Sequence
  Synthetically generated peptide
  misc_feature (14)..(14): Xaa can be Cys or D-Cys
GCCEICCTPACTGXK

SEQ ID NO: 615 - protein, 15 aa, Artificial Sequence
  Synthetically generated peptide
  misc_feature (14)..(14): Xaa can be Cys or D-Cys
GCCEICCTPACTGXY

SEQ ID NO: 616 - protein, 14 aa, Artificial Sequence
  Synthetically generated peptide
  misc_feature (6)..(6): Xaa can be Cys or D-Cys
GCCEIXCNPACTGC

SEQ ID NO: 617 - protein, 15 aa, Artificial Sequence
  Synthetically generated peptide
  misc_feature (6)..(6): Xaa can be Cys or D-Cys
GCCEIXCNPACTGCK

SEQ ID NO: 618 - protein, 15 aa, Artificial Sequence
  Synthetically generated peptide
  misc_feature (6)..(6): Xaa can be Cys or D-Cys
GCCEIXCNPACTGCY

SEQ ID NO: 619 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
GCCEIXCNPACTGX

SEQ ID NO: 620 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
GCCEIXCNPACTGXK

SEQ ID NO: 621 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
GCCEIXCNPACTGXY

SEQ ID NO: 622 - protein, 14 aa, Artificial Sequence
  Synthetically generated peptide
  misc_feature (6)..(6): Xaa can be Cys or D-Cys
GCCEIXCTPACTGC

SEQ ID NO: 623 - protein, 15 aa, Artificial Sequence
  Synthetically generated peptide
  misc_feature (6)..(6): Xaa can be Cys or D-Cys
GCCEIXCTPACTGCK

SEQ ID NO: 624 - protein, 15 aa, Artificial Sequence
  Synthetically generated peptide
  misc_feature (6)..(6): Xaa can be Cys or D-Cys
GCCEIXCTPACTGCY

SEQ ID NO: 625 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
GCCEIXCTPACTGX

SEQ ID NO: 626 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
GCCEIXCTPACTGXK

SEQ ID NO: 627 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
GCCEIXCTPACTGXY

SEQ ID NO: 628 - protein, 14 aa, Artificial Sequence
  Synthetically generated peptide
GCCELCCNPACTGC

SEQ ID NO: 629 - protein, 15 aa, Artificial Sequence
  Synthetically generated peptide
GCCELCCNPACTGCK

SEQ ID NO: 630 - protein, 15 aa, Artificial Sequence
  Synthetically generated peptide
GCCELCCNPACTGCY

SEQ ID NO: 631 - protein, 14 aa, Artificial Sequence
  Synthetically generated peptide
  misc_feature (14)..(14): Xaa can be Cys or D-Cys
GCCELCCNPACTGX

SEQ ID NO: 632 - protein, 15 aa, Artificial Sequence
  Synthetically generated peptide
  misc_feature (14)..(14): Xaa can be Cys or D-Cys
GCCELCCNPACTGXK

SEQ ID NO: 633 - protein, 15 aa, Artificial Sequence
  Synthetically generated peptide
  misc_feature (14)..(14): Xaa can be Cys or D-Cys
GCCELCCNPACTGXY

SEQ ID NO: 634 - protein, 14 aa, Artificial Sequence
  Synthetically generated peptide
GCCELCCTPACTGC

SEQ ID NO: 635 - protein, 15 aa, Artificial Sequence
  Synthetically generated peptide
GCCELCCTPACTGCK

SEQ ID NO: 636 - protein, 15 aa, Artificial Sequence
  Synthetically generated peptide
GCCELCCTPACTGCY

SEQ ID NO: 637 - protein, 14 aa, Artificial Sequence
  Synthetically generated peptide
  misc_feature (14)..(14): Xaa can be Cys or D-Cys
GCCELCCTPACTGX

SEQ ID NO: 638 - protein, 15 aa, Artificial Sequence
  Synthetically generated peptide
  misc_feature (14)..(14): Xaa can be Cys or D-Cys
GCCELCCTPACTGXK

SEQ ID NO: 639 - protein, 15 aa, Artificial Sequence
  Synthetically generated peptide
  misc_feature (14)..(14): Xaa can be Cys or D-Cys
GCCELCCTPACTGXY

SEQ ID NO: 640 - protein, 14 aa, Artificial Sequence
  Synthetically generated peptide
  misc_feature (6)..(6): Xaa can be Cys or D-Cys
GCCELXCNPACTGC

SEQ ID NO: 641 - protein, 15 aa, Artificial Sequence
  Synthetically generated peptide
  misc_feature (6)..(6): Xaa can be Cys or D-Cys
GCCELXCNPACTGCK

SEQ ID NO: 642 - protein, 15 aa, Artificial Sequence
  Synthetically generated peptide
  misc_feature (6)..(6): Xaa can be Cys or D-Cys
GCCELXCNPACTGCY

SEQ ID NO: 643 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
GCCELXCNPACTGX

SEQ ID NO: 644 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
GCCELXCNPACTGXK

SEQ ID NO: 645 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
GCCELXCNPACTGXY

SEQ ID NO: 646 - protein, 14 aa, Artificial Sequence
  Synthetically generated peptide
  misc_feature (6)..(6): Xaa can be Cys or D-Cys
GCCELXCTPACTGC

SEQ ID NO: 647 - protein, 15 aa, Artificial Sequence
  Synthetically generated peptide
  misc_feature (6)..(6): Xaa can be Cys or D-Cys
GCCELXCTPACTGCK

SEQ ID NO: 648 - protein, 15 aa, Artificial Sequence
  Synthetically generated peptide
  misc_feature (6)..(6): Xaa can be Cys or D-Cys
GCCELXCTPACTGCY

SEQ ID NO: 649 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
GCCELXCTPACTGX

SEQ ID NO: 650 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
GCCELXCTPACTGXK

SEQ ID NO: 651 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
GCCELXCTPACTGXY

SEQ ID NO: 652 - protein, 14 aa, Artificial Sequence
  Synthetically generated peptide
GCCEYCCNPACTGC

SEQ ID NO: 653 - protein, 15 aa, Artificial Sequence
  Synthetically generated peptide
GCCEYCCNPACTGCK

SEQ ID NO: 654 - protein, 15 aa, Artificial Sequence
  Synthetically generated peptide
GCCEYCCNPACTGCY

SEQ ID NO: 655 - protein, 14 aa, Artificial Sequence
  Synthetically generated peptide
  misc_feature (14)..(14): Xaa can be Cys or D-Cys
GCCEYCCNPACTGX

SEQ ID NO: 656 - protein, 15 aa, Artificial Sequence
  Synthetically generated peptide
  misc_feature (14)..(14): Xaa can be Cys or D-Cys
GCCEYCCNPACTGXK

SEQ ID NO: 657 - protein, 15 aa, Artificial Sequence
  Synthetically generated peptide
  misc_feature (14)..(14): Xaa can be Cys or D-Cys
GCCEYCCNPACTGXY

SEQ ID NO: 658 - protein, 14 aa, Artificial Sequence
  Synthetically generated peptide
GCCEYCCTPACTGC

SEQ ID NO: 659 - protein, 15 aa, Artificial Sequence
  Synthetically generated peptide
GCCEYCCTPACTGCK

SEQ ID NO: 660 - protein, 15 aa, Artificial Sequence
  Synthetically generated peptide
GCCEYCCTPACTGCY

SEQ ID NO: 661 - protein, 14 aa, Artificial Sequence
  Synthetically generated peptide
  misc_feature (14)..(14): Xaa can be Cys or D-Cys
GCCEYCCTPACTGX

SEQ ID NO: 662 - protein, 15 aa, Artificial Sequence
  Synthetically generated peptide
  misc_feature (14)..(14): Xaa can be Cys or D-Cys
GCCEYCCTPACTGXK

SEQ ID NO: 663 - protein, 15 aa, Artificial Sequence
  Synthetically generated peptide
  misc_feature (14)..(14): Xaa can be Cys or D-Cys
GCCEYCCTPACTGXY

SEQ ID NO: 664 - protein, 14 aa, Artificial Sequence
  Synthetically generated peptide
  misc_feature (6)..(6): Xaa can be Cys or D-Cys
GCCEYXCNPACTGC

SEQ ID NO: 665 - protein, 15 aa, Artificial Sequence
  Synthetically generated peptide
  misc_feature (6)..(6): Xaa can be Cys or D-Cys
GCCEYXCNPACTGCK

SEQ ID NO: 666 - protein, 15 aa, Artificial Sequence
  Synthetically generated peptide
  misc_feature (6)..(6): Xaa can be Cys or D-Cys
GCCEYXCNPACTGCY

SEQ ID NO: 667 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
GCCEYXCNPACTGX

SEQ ID NO: 668 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
GCCEYXCNPACTGXK

SEQ ID NO: 669 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
GCCEYXCNPACTGXY

SEQ ID NO: 670 - protein, 14 aa, Artificial Sequence
  Synthetically generated peptide
  misc_feature (6)..(6): Xaa can be Cys or D-Cys
GCCEYXCTPACTGC

SEQ ID NO: 671 - protein, 15 aa, Artificial Sequence
  Synthetically generated peptide
  misc_feature (6)..(6): Xaa can be Cys or D-Cys
GCCEYXCTPACTGCK

SEQ ID NO: 672 - protein, 15 aa, Artificial Sequence
  Synthetically generated peptide
  misc_feature (6)..(6): Xaa can be Cys or D-Cys
GCCEYXCTPACTGCY

SEQ ID NO: 673 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
GCCEYXCTPACTGX

SEQ ID NO: 674 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
GCCEYXCTPACTGXK

SEQ ID NO: 675 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
GCCEYXCTPACTGXY

SEQ ID NO: 676 - protein, 14 aa, Artificial Sequence
  Synthetically generated peptide
GCCEFCCNPACTGC

SEQ ID NO: 677 - protein, 15 aa, Artificial Sequence
  Synthetically generated peptide
GCCEFCCNPACTGCK

SEQ ID NO: 678 - protein, 15 aa, Artificial Sequence
  Synthetically generated peptide
GCCEFCCNPACTGCY

SEQ ID NO: 679 - protein, 14 aa, Artificial Sequence
  Synthetically generated peptide
  misc_feature (14)..(14): Xaa can be Cys or D-Cys
GCCEFCCNPACTGX

SEQ ID NO: 680 - protein, 15 aa, Artificial Sequence
  Synthetically generated peptide
  misc_feature (14)..(14): Xaa can be Cys or D-Cys
GCCEFCCNPACTGXK

SEQ ID NO: 681 - protein, 15 aa, Artificial Sequence
  Synthetically generated peptide
  misc_feature (14)..(14): Xaa can be Cys or D-Cys
GCCEFCCNPACTGXY

SEQ ID NO: 682 - protein, 14 aa, Artificial Sequence
  Synthetically generated peptide
GCCEFCCTPACTGC

SEQ ID NO: 683 - protein, 15 aa, Artificial Sequence
  Synthetically generated peptide
GCCEFCCTPACTGCK

SEQ ID NO: 684 - protein, 15 aa, Artificial Sequence
  Synthetically generated peptide
GCCEFCCTPACTGCY

SEQ ID NO: 685 - protein, 14 aa, Artificial Sequence
  Synthetically generated peptide
  misc_feature (14)..(14): Xaa can be Cys or D-Cys
GCCEFCCTPACTGX

SEQ ID NO: 686 - protein, 15 aa, Artificial Sequence
  Synthetically generated peptide
  misc_feature (14)..(14): Xaa can be Cys or D-Cys
GCCEFCCTPACTGXK

SEQ ID NO: 687 - protein, 15 aa, Artificial Sequence
  Synthetically generated peptide
  misc_feature (14)..(14): Xaa can be Cys or D-Cys
GCCEFCCTPACTGXY

SEQ ID NO: 688 - protein, 14 aa, Artificial Sequence
  Synthetically generated peptide
  misc_feature (6)..(6): Xaa can be Cys or D-Cys
GCCEFXCNPACTGC

SEQ ID NO: 689 - protein, 15 aa, Artificial Sequence
  Synthetically generated peptide
  misc_feature (6)..(6): Xaa can be Cys or D-Cys
GCCEFXCNPACTGCK

SEQ ID NO: 690 - protein, 15 aa, Artificial Sequence
  Synthetically generated peptide
  misc_feature (6)..(6): Xaa can be Cys or D-Cys
GCCEFXCNPACTGCY

SEQ ID NO: 691 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
GCCEFXCNPACTGX

SEQ ID NO: 692 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
GCCEFXCNPACTGXK

SEQ ID NO: 693 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
GCCEFXCNPACTGXY

SEQ ID NO: 694 - protein, 14 aa, Artificial Sequence
  Synthetically generated peptide
  misc_feature (6)..(6): Xaa can be Cys or D-Cys
GCCEFXCTPACTGC

SEQ ID NO: 695 - protein, 15 aa, Artificial Sequence
  Synthetically generated peptide
  misc_feature (6)..(6): Xaa can be Cys or D-Cys
GCCEFXCTPACTGCK

SEQ ID NO: 696 - protein, 15 aa, Artificial Sequence
  Synthetically generated peptide
  misc_feature (6)..(6): Xaa can be Cys or D-Cys
GCCEFXCTPACTGCY

SEQ ID NO: 697 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
GCCEFXCTPACTGX

SEQ ID NO: 698 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
GCCEFXCTPACTGXK

SEQ ID NO: 699 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
GCCEFXCTPACTGXY

SEQ ID NO: 700 - protein, 14 aa, Artificial Sequence
  Synthetically generated peptide
GCCEWCCNPACTGC

SEQ ID NO: 701 - protein, 15 aa, Artificial Sequence
  Synthetically generated peptide
GCCEWCCNPACTGCK

SEQ ID NO: 702 - protein, 15 aa, Artificial Sequence
  Synthetically generated peptide
GCCEWCCNPACTGCY

SEQ ID NO: 703 - protein, 14 aa, Artificial Sequence
  Synthetically generated peptide
  misc_feature (14)..(14): Xaa can be Cys or D-Cys
GCCEWCCNPACTGX

SEQ ID NO: 704 - protein, 15 aa, Artificial Sequence
  Synthetically generated peptide
  misc_feature (14)..(14): Xaa can be Cys or D-Cys
GCCEWCCNPACTGXK

SEQ ID NO: 705 - protein, 15 aa, Artificial Sequence
  Synthetically generated peptide
  misc_feature (14)..(14): Xaa can be Cys or D-Cys
GCCEWCCNPACTGXY

SEQ ID NO: 706 - protein, 14 aa, Artificial Sequence
  Synthetically generated peptide
GCCEWCCTPACTGC

SEQ ID NO: 707 - protein, 15 aa, Artificial Sequence
  Synthetically generated peptide
GCCEWCCTPACTGCK

SEQ ID NO: 708 - protein, 15 aa, Artificial Sequence
  Synthetically generated peptide
GCCEWCCTPACTGCY

SEQ ID NO: 709 - protein, 14 aa, Artificial Sequence
  Synthetically generated peptide
  misc_feature (14)..(14): Xaa can be Cys or D-Cys
GCCEWCCTPACTGX

SEQ ID NO: 710 - protein, 15 aa, Artificial Sequence
  Synthetically generated peptide
  misc_feature (14)..(14): Xaa can be Cys or D-Cys
GCCEWCCTPACTGXK

SEQ ID NO: 711 - protein, 15 aa, Artificial Sequence
  Synthetically generated peptide
  misc_feature (14)..(14): Xaa can be Cys or D-Cys
GCCEWCCTPACTGXY

SEQ ID NO: 712 - protein, 14 aa, Artificial Sequence
  Synthetically generated peptide
  misc_feature (6)..(6): Xaa can be Cys or D-Cys
GCCEWXCNPACTGC

SEQ ID NO: 713 - protein, 15 aa, Artificial Sequence
  Synthetically generated peptide
  misc_feature (6)..(6): Xaa can be Cys or D-Cys
GCCEWXCNPACTGCK

SEQ ID NO: 714 - protein, 15 aa, Artificial Sequence
  Synthetically generated peptide
  misc_feature (6)..(6): Xaa can be Cys or D-Cys
GCCEWXCNPACTGCY

SEQ ID NO: 715 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
GCCEWXCNPACTGX

SEQ ID NO: 716 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
GCCEWXCNPACTGXK

SEQ ID NO: 717 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
GCCEWXCNPACTGXY

SEQ ID NO: 718 - protein, 14 aa, Artificial Sequence
  Synthetically generated peptide
  misc_feature (6)..(6): Xaa can be Cys or D-Cys
GCCEWXCTPACTGC

SEQ ID NO: 719 - protein, 15 aa, Artificial Sequence
  Synthetically generated peptide
  misc_feature (6)..(6): Xaa can be Cys or D-Cys
GCCEWXCTPACTGCK

SEQ ID NO: 720 - protein, 15 aa, Artificial Sequence
  Synthetically generated peptide
  misc_feature (6)..(6): Xaa can be Cys or D-Cys
GCCEWXCTPACTGCY

SEQ ID NO: 721 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
GCCEWXCTPACTGX

SEQ ID NO: 722 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
GCCEWXCTPACTGXK

SEQ ID NO: 723 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
GCCEWXCTPACTGXY

SEQ ID NO: 724 - protein, 14 aa, Artificial Sequence
  Synthetically generated peptide
  misc_feature (2)..(2): Xaa can be Cys or D-Cys
GXCEVCCNPACTGC

SEQ ID NO: 725 - protein, 15 aa, Artificial Sequence
  Synthetically generated peptide
  misc_feature (2)..(2): Xaa can be Cys or D-Cys
GXCEVCCNPACTGCK

SEQ ID NO: 726 - protein, 15 aa, Artificial Sequence
  Synthetically generated peptide
  misc_feature (2)..(2): Xaa can be Cys or D-Cys
GXCEVCCNPACTGCY

SEQ ID NO: 727 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
GXCEVCCNPACTGX

SEQ ID NO: 728 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
GXCEVCCNPACTGXK

SEQ ID NO: 729 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
GXCEVCCNPACTGXY

SEQ ID NO: 730 - protein, 14 aa, Artificial Sequence
  Synthetically generated peptide
  misc_feature (2)..(2): Xaa can be Cys or D-Cys
GXCEVCCTPACTGC

SEQ ID NO: 731 - protein, 15 aa, Artificial Sequence
  Synthetically generated peptide
  misc_feature (2)..(2): Xaa can be Cys or D-Cys
GXCEVCCTPACTGCK

SEQ ID NO: 732 - protein, 15 aa, Artificial Sequence
  Synthetically generated peptide
  misc_feature (2)..(2): Xaa can be Cys or D-Cys
GXCEVCCTPACTGCY

SEQ ID NO: 733 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
GXCEVCCTPACTGX

SEQ ID NO: 734 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
GXCEVCCTPACTGXK

SEQ ID NO: 735 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
GXCEVCCTPACTGXY

SEQ ID NO: 736 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
GXCEVXCNPACTGC

SEQ ID NO: 737 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
GXCEVXCNPACTGCK

SEQ ID NO: 738 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
GXCEVXCNPACTGCY

SEQ ID NO: 739 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCEVXCNPACTGX

SEQ ID NO: 740 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCEVXCNPACTGXK

SEQ ID NO: 741 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCEVXCNPACTGXY

SEQ ID NO: 742 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
GXCEVXCTPACTGC

SEQ ID NO: 743 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
GXCEVXCTPACTGCK

SEQ ID NO: 744 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
GXCEVXCTPACTGCY

SEQ ID NO: 745 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCEVXCTPACTGX

SEQ ID NO: 746 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCEVXCTPACTGXK

SEQ ID NO: 747 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCEVXCTPACTGXY

SEQ ID NO: 748 - protein, 14 aa, Artificial Sequence
  Synthetically generated peptide
  misc_feature (2)..(2): Xaa can be Cys or D-Cys
GXCEICCNPACTGC

SEQ ID NO: 749 - protein, 15 aa, Artificial Sequence
  Synthetically generated peptide
  misc_feature (2)..(2): Xaa can be Cys or D-Cys
GXCEICCNPACTGCK

SEQ ID NO: 750 - protein, 15 aa, Artificial Sequence
  Synthetically generated peptide
  misc_feature (2)..(2): Xaa can be Cys or D-Cys
GXCEICCNPACTGCY

SEQ ID NO: 751 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
GXCEICCNPACTGX

SEQ ID NO: 752 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
GXCEICCNPACTGXK

SEQ ID NO: 753 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
GXCEICCNPACTGXY

SEQ ID NO: 754 - protein, 14 aa, Artificial Sequence
  Synthetically generated peptide
  misc_feature (2)..(2): Xaa can be Cys or D-Cys
GXCEICCTPACTGC

SEQ ID NO: 755 - protein, 15 aa, Artificial Sequence
  Synthetically generated peptide
  misc_feature (2)..(2): Xaa can be Cys or D-Cys
GXCEICCTPACTGCK

SEQ ID NO: 756 - protein, 15 aa, Artificial Sequence
  Synthetically generated peptide
  misc_feature (2)..(2): Xaa can be Cys or D-Cys
GXCEICCTPACTGCY

SEQ ID NO: 757 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
GXCEICCTPACTGX

SEQ ID NO: 758 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
GXCEICCTPACTGXK

SEQ ID NO: 759 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
GXCEICCTPACTGXY

SEQ ID NO: 760 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
GXCEIXCNPACTGC

SEQ ID NO: 761 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
GXCEIXCNPACTGCK

SEQ ID NO: 762 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
GXCEIXCNPACTGCY

SEQ ID NO: 763 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCEIXCNPACTGX

SEQ ID NO: 764 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCEIXCNPACTGXK

SEQ ID NO: 765 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCEIXCNPACTGXY

SEQ ID NO: 766 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
GXCEIXCTPACTGC

SEQ ID NO: 767 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
GXCEIXCTPACTGCK

SEQ ID NO: 768 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
GXCEIXCTPACTGCY

SEQ ID NO: 769 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCEIXCTPACTGX

SEQ ID NO: 770 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCEIXCTPACTGXK

SEQ ID NO: 771 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCEIXCTPACTGXY

SEQ ID NO: 772 - protein, 14 aa, Artificial Sequence
  Synthetically generated peptide
  misc_feature (2)..(2): Xaa can be Cys or D-Cys
GXCELCCNPACTGC

SEQ ID NO: 773 - protein, 15 aa, Artificial Sequence
  Synthetically generated peptide
  misc_feature (2)..(2): Xaa can be Cys or D-Cys
GXCELCCNPACTGCK

SEQ ID NO: 774 - protein, 15 aa, Artificial Sequence
  Synthetically generated peptide
  misc_feature (2)..(2): Xaa can be Cys or D-Cys
GXCELCCNPACTGCY

SEQ ID NO: 775 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
GXCELCCNPACTGX

SEQ ID NO: 776 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
GXCELCCNPACTGXK

SEQ ID NO: 777 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
GXCELCCNPACTGXY

SEQ ID NO: 778 - protein, 14 aa, Artificial Sequence
  Synthetically generated peptide
  misc_feature (2)..(2): Xaa can be Cys or D-Cys
GXCELCCTPACTGC

SEQ ID NO: 779 - protein, 15 aa, Artificial Sequence
  Synthetically generated peptide
  misc_feature (2)..(2): Xaa can be Cys or D-Cys
GXCELCCTPACTGCK

SEQ ID NO: 780 - protein, 15 aa, Artificial Sequence
  Synthetically generated peptide
  misc_feature (2)..(2): Xaa can be Cys or D-Cys
GXCELCCTPACTGCY

SEQ ID NO: 781 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
GXCELCCTPACTGX

SEQ ID NO: 782 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
GXCELCCTPACTGXK

SEQ ID NO: 783 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
GXCELCCTPACTGXY

SEQ ID NO: 784 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
GXCELXCNPACTGC

SEQ ID NO: 785 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
GXCELXCNPACTGCK

SEQ ID NO: 786 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
GXCELXCNPACTGCY

SEQ ID NO: 787 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCELXCNPACTGX

SEQ ID NO: 788 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCELXCNPACTGXK

SEQ ID NO: 789 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCELXCNPACTGXY

SEQ ID NO: 790 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
GXCELXCTPACTGC

SEQ ID NO: 791 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
GXCELXCTPACTGCK

SEQ ID NO: 792 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
GXCELXCTPACTGCY

SEQ ID NO: 793 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCELXCTPACTGX

SEQ ID NO: 794 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCELXCTPACTGXK

SEQ ID NO: 795 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCELXCTPACTGXY

SEQ ID NO: 796 - protein, 14 aa, Artificial Sequence
  Synthetically generated peptide
  misc_feature (2)..(2): Xaa can be Cys or D-Cys
GXCEYCCNPACTGC

SEQ ID NO: 797 - protein, 15 aa, Artificial Sequence
  Synthetically generated peptide
  misc_feature (2)..(2): Xaa can be Cys or D-Cys
GXCEYCCNPACTGCK

SEQ ID NO: 798 - protein, 15 aa, Artificial Sequence
  Synthetically generated peptide
  misc_feature (2)..(2): Xaa can be Cys or D-Cys
GXCEYCCNPACTGCY

SEQ ID NO: 799 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
GXCEYCCNPACTGX

SEQ ID NO: 800 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
GXCEYCCNPACTGXK

SEQ ID NO: 801 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
GXCEYCCNPACTGXY

SEQ ID NO: 802 - protein, 14 aa, Artificial Sequence
  Synthetically generated peptide
  misc_feature (2)..(2): Xaa can be Cys or D-Cys
GXCEYCCTPACTGC

SEQ ID NO: 803 - protein, 15 aa, Artificial Sequence
  Synthetically generated peptide
  misc_feature (2)..(2): Xaa can be Cys or D-Cys
GXCEYCCTPACTGCK

SEQ ID NO: 804 - protein, 15 aa, Artificial Sequence
  Synthetically generated peptide
  misc_feature (2)..(2): Xaa can be Cys or D-Cys
GXCEYCCTPACTGCY

SEQ ID NO: 805 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
GXCEYCCTPACTGX

SEQ ID NO: 806 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
GXCEYCCTPACTGXK

SEQ ID NO: 807 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
GXCEYCCTPACTGXY

SEQ ID NO: 808 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
GXCEYXCNPACTGC

SEQ ID NO: 809 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
GXCEYXCNPACTGCK

SEQ ID NO: 810 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
GXCEYXCNPACTGCY

SEQ ID NO: 811 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCEYXCNPACTGX

SEQ ID NO: 812 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCEYXCNPACTGXK

SEQ ID NO: 813 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCEYXCNPACTGXY

SEQ ID NO: 814 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
GXCEYXCTPACTGC

SEQ ID NO: 815 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
GXCEYXCTPACTGCK

SEQ ID NO: 816 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
GXCEYXCTPACTGCY

SEQ ID NO: 817 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCEYXCTPACTGX

SEQ ID NO: 818 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCEYXCTPACTGXK

SEQ ID NO: 819 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCEYXCTPACTGXY

SEQ ID NO: 820 - protein, 14 aa, Artificial Sequence
  Synthetically generated peptide
  misc_feature (2)..(2): Xaa can be Cys or D-Cys
GXCEFCCNPACTGC

SEQ ID NO: 821 - protein, 15 aa, Artificial Sequence
  Synthetically generated peptide
  misc_feature (2)..(2): Xaa can be Cys or D-Cys
GXCEFCCNPACTGCK

SEQ ID NO: 822 - protein, 15 aa, Artificial Sequence
  Synthetically generated peptide
  misc_feature (2)..(2): Xaa can be Cys or D-Cys
GXCEFCCNPACTGCY

SEQ ID NO: 823 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
GXCEFCCNPACTGX

SEQ ID NO: 824 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
GXCEFCCNPACTGXK

SEQ ID NO: 825 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
GXCEFCCNPACTGXY

SEQ ID NO: 826 - protein, 14 aa, Artificial Sequence
  Synthetically generated peptide
  misc_feature (2)..(2): Xaa can be Cys or D-Cys
GXCEFCCTPACTGC

SEQ ID NO: 827 - protein, 15 aa, Artificial Sequence
  Synthetically generated peptide
  misc_feature (2)..(2): Xaa can be Cys or D-Cys
GXCEFCCTPACTGCK

SEQ ID NO: 828 - protein, 15 aa, Artificial Sequence
  Synthetically generated peptide
  misc_feature (2)..(2): Xaa can be Cys or D-Cys
GXCEFCCTPACTGCY

SEQ ID NO: 829 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
GXCEFCCTPACTGX

SEQ ID NO: 830 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
GXCEFCCTPACTGXK

SEQ ID NO: 831 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
GXCEFCCTPACTGXY

SEQ ID NO: 832 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
GXCEFXCNPACTGC

SEQ ID NO: 833 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
GXCEFXCNPACTGCK

SEQ ID NO: 834 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
GXCEFXCNPACTGCY

SEQ ID NO: 835 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCEFXCNPACTGX

SEQ ID NO: 836 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCEFXCNPACTGXK

SEQ ID NO: 837 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCEFXCNPACTGXY

SEQ ID NO: 838 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
GXCEFXCTPACTGC

SEQ ID NO: 839 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
GXCEFXCTPACTGCK

SEQ ID NO: 840 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
GXCEFXCTPACTGCY

SEQ ID NO: 841 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCEFXCTPACTGX

SEQ ID NO: 842 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCEFXCTPACTGXK

SEQ ID NO: 843 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCEFXCTPACTGXY

SEQ ID NO: 844 - protein, 14 aa, Artificial Sequence
  Synthetically generated peptide
  misc_feature (2)..(2): Xaa can be Cys or D-Cys
GXCEWCCNPACTGC

SEQ ID NO: 845 - protein, 15 aa, Artificial Sequence
  Synthetically generated peptide
  misc_feature (2)..(2): Xaa can be Cys or D-Cys
GXCEWCCNPACTGCK

SEQ ID NO: 846 - protein, 15 aa, Artificial Sequence
  Synthetically generated peptide
  misc_feature (2)..(2): Xaa can be Cys or D-Cys
GXCEWCCNPACTGCY

SEQ ID NO: 847 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
GXCEWCCNPACTGX

SEQ ID NO: 848 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
GXCEWCCNPACTGXK

SEQ ID NO: 849 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
GXCEWCCNPACTGXY

SEQ ID NO: 850 - protein, 14 aa, Artificial Sequence
  Synthetically generated peptide
  misc_feature (2)..(2): Xaa can be Cys or D-Cys
GXCEWCCTPACTGC

SEQ ID NO: 851 - protein, 15 aa, Artificial Sequence
  Synthetically generated peptide
  misc_feature (2)..(2): Xaa can be Cys or D-Cys
GXCEWCCTPACTGCK

SEQ ID NO: 852 - protein, 15 aa, Artificial Sequence
  Synthetically generated peptide
  misc_feature (2)..(2): Xaa can be Cys or D-Cys
GXCEWCCTPACTGCY

SEQ ID NO: 853 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
GXCEWCCTPACTGX

SEQ ID NO: 854 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
GXCEWCCTPACTGXK

SEQ ID NO: 855 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
GXCEWCCTPACTGXY

SEQ ID NO: 856 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
GXCEWXCNPACTGC

SEQ ID NO: 857 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
GXCEWXCNPACTGCK

SEQ ID NO: 858 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
GXCEWXCNPACTGCY

SEQ ID NO: 859 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCEWXCNPACTGX

SEQ ID NO: 860 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCEWXCNPACTGXK

SEQ ID NO: 861 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCEWXCNPACTGXY

SEQ ID NO: 862 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
GXCEWXCTPACTGC

SEQ ID NO: 863 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
GXCEWXCTPACTGCK

SEQ ID NO: 864 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
GXCEWXCTPACTGCY

SEQ ID NO: 865 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCEWXCTPACTGX

SEQ ID NO: 866 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCEWXCTPACTGXK

SEQ ID NO: 867 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
GXCEWXCTPACTGXY

SEQ ID NO: 868 - protein, 14 aa, Artificial Sequence
  Synthetically generated peptide
KCCEVCCNPACTGC

SEQ ID NO: 869 - protein, 15 aa, Artificial Sequence
  Synthetically generated peptide
KCCEVCCNPACTGCK

SEQ ID NO: 870 - protein, 15 aa, Artificial Sequence
  Synthetically generated peptide
KCCEVCCNPACTGCY

SEQ ID NO: 871 - protein, 14 aa, Artificial Sequence
  Synthetically generated peptide
  misc_feature (14)..(14): Xaa can be Cys or D-Cys
KCCEVCCNPACTGX

SEQ ID NO: 872 - protein, 15 aa, Artificial Sequence
  Synthetically generated peptide
  misc_feature (14)..(14): Xaa can be Cys or D-Cys
KCCEVCCNPACTGXK

SEQ ID NO: 873 - protein, 15 aa, Artificial Sequence
  Synthetically generated peptide
  misc_feature (14)..(14): Xaa can be Cys or D-Cys
KCCEVCCNPACTGXY

SEQ ID NO: 874 - protein, 14 aa, Artificial Sequence
  Synthetically generated peptide
KCCEVCCTPACTGC

SEQ ID NO: 875 - protein, 15 aa, Artificial Sequence
  Synthetically generated peptide
KCCEVCCTPACTGCK

SEQ ID NO: 876 - protein, 15 aa, Artificial Sequence
  Synthetically generated peptide
KCCEVCCTPACTGCY

SEQ ID NO: 877 - protein, 14 aa, Artificial Sequence
  Synthetically generated peptide
  misc_feature (14)..(14): Xaa can be Cys or D-Cys
KCCEVCCTPACTGX

SEQ ID NO: 878 - protein, 15 aa, Artificial Sequence
  Synthetically generated peptide
  misc_feature (14)..(14): Xaa can be Cys or D-Cys
KCCEVCCTPACTGXK

SEQ ID NO: 879 - protein, 15 aa, Artificial Sequence
  Synthetically generated peptide
  misc_feature (14)..(14): Xaa can be Cys or D-Cys
KCCEVCCTPACTGXY

SEQ ID NO: 880 - protein, 14 aa, Artificial Sequence
  Synthetically generated peptide
  misc_feature (6)..(6): Xaa can be Cys or D-Cys
KCCEVXCNPACTGC

SEQ ID NO: 881 - protein, 15 aa, Artificial Sequence
  Synthetically generated peptide
  misc_feature (6)..(6): Xaa can be Cys or D-Cys
KCCEVXCNPACTGCK

SEQ ID NO: 882 - protein, 15 aa, Artificial Sequence
  Synthetically generated peptide
  misc_feature (6)..(6): Xaa can be Cys or D-Cys
KCCEVXCNPACTGCY

SEQ ID NO: 883 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
KCCEVXCNPACTGX

SEQ ID NO: 884 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
KCCEVXCNPACTGXK

SEQ ID NO: 885 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
KCCEVXCNPACTGXY

SEQ ID NO: 886 - protein, 14 aa, Artificial Sequence
  Synthetically generated peptide
  misc_feature (6)..(6): Xaa can be Cys or D-Cys
KCCEVXCTPACTGC

SEQ ID NO: 887 - protein, 15 aa, Artificial Sequence
  Synthetically generated peptide
  misc_feature (6)..(6): Xaa can be Cys or D-Cys
KCCEVXCTPACTGCK

SEQ ID NO: 888 - protein, 15 aa, Artificial Sequence
  Synthetically generated peptide
  misc_feature (6)..(6): Xaa can be Cys or D-Cys
KCCEVXCTPACTGCY

SEQ ID NO: 889 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
KCCEVXCTPACTGX

SEQ ID NO: 890 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
KCCEVXCTPACTGXK

SEQ ID NO: 891 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
KCCEVXCTPACTGXY

SEQ ID NO: 892 - protein, 14 aa, Artificial Sequence
  Synthetically generated peptide
KCCEICCNPACTGC

SEQ ID NO: 893 - protein, 15 aa, Artificial Sequence
  Synthetically generated peptide
KCCEICCNPACTGCK

SEQ ID NO: 894 - protein, 15 aa, Artificial Sequence
  Synthetically generated peptide
KCCEICCNPACTGCY

SEQ ID NO: 895 - protein, 14 aa, Artificial Sequence
  Synthetically generated peptide
  misc_feature (14)..(14): Xaa can be Cys or D-Cys
KCCEICCNPACTGX

SEQ ID NO: 896 - protein, 15 aa, Artificial Sequence
  Synthetically generated peptide
  misc_feature (14)..(14): Xaa can be Cys or D-Cys
KCCEICCNPACTGXK

SEQ ID NO: 897 - protein, 15 aa, Artificial Sequence
  Synthetically generated peptide
  misc_feature (14)..(14): Xaa can be Cys or D-Cys
KCCEICCNPACTGXY

SEQ ID NO: 898 - protein, 14 aa, Artificial Sequence
  Synthetically generated peptide
KCCEICCTPACTGC

SEQ ID NO: 899 - protein, 15 aa, Artificial Sequence
  Synthetically generated peptide
KCCEICCTPACTGCK

SEQ ID NO: 900 - protein, 15 aa, Artificial Sequence
  Synthetically generated peptide
KCCEICCTPACTGCY

SEQ ID NO: 901 - protein, 14 aa, Artificial Sequence
  Synthetically generated peptide
  misc_feature (14)..(14): Xaa can be Cys or D-Cys
KCCEICCTPACTGX

SEQ ID NO: 902 - protein, 15 aa, Artificial Sequence
  Synthetically generated peptide
  misc_feature (14)..(14): Xaa can be Cys or D-Cys
KCCEICCTPACTGXK

SEQ ID NO: 903 - protein, 15 aa, Artificial Sequence
  Synthetically generated peptide
  misc_feature (14)..(14): Xaa can be Cys or D-Cys
KCCEICCTPACTGXY

SEQ ID NO: 904 - protein, 14 aa, Artificial Sequence
  Synthetically generated peptide
  misc_feature (6)..(6): Xaa can be Cys or D-Cys
KCCEIXCNPACTGC

SEQ ID NO: 905 - protein, 15 aa, Artificial Sequence
  Synthetically generated peptide
  misc_feature (6)..(6): Xaa can be Cys or D-Cys
KCCEIXCNPACTGCK

SEQ ID NO: 906 - protein, 15 aa, Artificial Sequence
  Synthetically generated peptide
  misc_feature (6)..(6): Xaa can be Cys or D-Cys
KCCEIXCNPACTGCY

SEQ ID NO: 907 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
KCCEIXCNPACTGX

SEQ ID NO: 908 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
KCCEIXCNPACTGXK

SEQ ID NO: 909 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
KCCEIXCNPACTGXY

SEQ ID NO: 910 - protein, 14 aa, Artificial Sequence
  Synthetically generated peptide
  misc_feature (6)..(6): Xaa can be Cys or D-Cys
KCCEIXCTPACTGC

SEQ ID NO: 911 - protein, 15 aa, Artificial Sequence
  Synthetically generated peptide
  misc_feature (6)..(6): Xaa can be Cys or D-Cys
KCCEIXCTPACTGCK

SEQ ID NO: 912 - protein, 15 aa, Artificial Sequence
  Synthetically generated peptide
  misc_feature (6)..(6): Xaa can be Cys or D-Cys
KCCEIXCTPACTGCY

SEQ ID NO: 913 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
KCCEIXCTPACTGX

SEQ ID NO: 914 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
KCCEIXCTPACTGXK

SEQ ID NO: 915 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
KCCEIXCTPACTGXY

SEQ ID NO: 916 - protein, 14 aa, Artificial Sequence
  Synthetically generated peptide
KCCELCCNPACTGC

SEQ ID NO: 917 - protein, 15 aa, Artificial Sequence
  Synthetically generated peptide
KCCELCCNPACTGCK

SEQ ID NO: 918 - protein, 15 aa, Artificial Sequence
  Synthetically generated peptide
KCCELCCNPACTGCY

SEQ ID NO: 919 - protein, 14 aa, Artificial Sequence
  Synthetically generated peptide
  misc_feature (14)..(14): Xaa can be Cys or D-Cys
KCCELCCNPACTGX

SEQ ID NO: 920 - protein, 15 aa, Artificial Sequence
  Synthetically generated peptide
  misc_feature (14)..(14): Xaa can be Cys or D-Cys
KCCELCCNPACTGXK

SEQ ID NO: 921 - protein, 15 aa, Artificial Sequence
  Synthetically generated peptide
  misc_feature (14)..(14): Xaa can be Cys or D-Cys
KCCELCCNPACTGXY

SEQ ID NO: 922 - protein, 14 aa, Artificial Sequence
  Synthetically generated peptide
KCCELCCTPACTGC

SEQ ID NO: 923 - protein, 15 aa, Artificial Sequence
  Synthetically generated peptide
KCCELCCTPACTGCK

SEQ ID NO: 924 - protein, 15 aa, Artificial Sequence
  Synthetically generated peptide
KCCELCCTPACTGCY

SEQ ID NO: 925 - protein, 14 aa, Artificial Sequence
  Synthetically generated peptide
  misc_feature (14)..(14): Xaa can be Cys or D-Cys
KCCELCCTPACTGX

SEQ ID NO: 926 - protein, 15 aa, Artificial Sequence
  Synthetically generated peptide
  misc_feature (14)..(14): Xaa can be Cys or D-Cys
KCCELCCTPACTGXK

SEQ ID NO: 927 - protein, 15 aa, Artificial Sequence
  Synthetically generated peptide
  misc_feature (14)..(14): Xaa can be Cys or D-Cys
KCCELCCTPACTGXY

SEQ ID NO: 928 - protein, 14 aa, Artificial Sequence
  Synthetically generated peptide
  misc_feature (6)..(6): Xaa can be Cys or D-Cys
KCCELXCNPACTGC

SEQ ID NO: 929 - protein, 15 aa, Artificial Sequence
  Synthetically generated peptide
  misc_feature (6)..(6): Xaa can be Cys or D-Cys
KCCELXCNPACTGCK

SEQ ID NO: 930 - protein, 15 aa, Artificial Sequence
  Synthetically generated peptide
  misc_feature (6)..(6): Xaa can be Cys or D-Cys
KCCELXCNPACTGCY

SEQ ID NO: 931 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
KCCELXCNPACTGX

SEQ ID NO: 932 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
KCCELXCNPACTGXK

SEQ ID NO: 933 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
KCCELXCNPACTGXY

SEQ ID NO: 934 - protein, 14 aa, Artificial Sequence
  Synthetically generated peptide
  misc_feature (6)..(6): Xaa can be Cys or D-Cys
KCCELXCTPACTGC

SEQ ID NO: 935 - protein, 15 aa, Artificial Sequence
  Synthetically generated peptide
  misc_feature (6)..(6): Xaa can be Cys or D-Cys
KCCELXCTPACTGCK

SEQ ID NO: 936 - protein, 15 aa, Artificial Sequence
  Synthetically generated peptide
  misc_feature (6)..(6): Xaa can be Cys or D-Cys
KCCELXCTPACTGCY

SEQ ID NO: 937 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
KCCELXCTPACTGX

SEQ ID NO: 938 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
KCCELXCTPACTGXK

SEQ ID NO: 939 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
KCCELXCTPACTGXY

SEQ ID NO: 940 - protein, 14 aa, Artificial Sequence
  Synthetically generated peptide
KCCEYCCNPACTGC

SEQ ID NO: 941 - protein, 15 aa, Artificial Sequence
  Synthetically generated peptide
KCCEYCCNPACTGCK

SEQ ID NO: 942 - protein, 15 aa, Artificial Sequence
  Synthetically generated peptide
KCCEYCCNPACTGCY

SEQ ID NO: 943 - protein, 14 aa, Artificial Sequence
  Synthetically generated peptide
  misc_feature (14)..(14): Xaa can be Cys or D-Cys
KCCEYCCNPACTGX

SEQ ID NO: 944 - protein, 15 aa, Artificial Sequence
  Synthetically generated peptide
  misc_feature (14)..(14): Xaa can be Cys or D-Cys
KCCEYCCNPACTGXK

SEQ ID NO: 945 - protein, 15 aa, Artificial Sequence
  Synthetically generated peptide
  misc_feature (14)..(14): Xaa can be Cys or D-Cys
KCCEYCCNPACTGXY

SEQ ID NO: 946 - protein, 14 aa, Artificial Sequence
  Synthetically generated peptide
KCCEYCCTPACTGC

SEQ ID NO: 947 - protein, 15 aa, Artificial Sequence
  Synthetically generated peptide
KCCEYCCTPACTGCK

SEQ ID NO: 948 - protein, 15 aa, Artificial Sequence
  Synthetically generated peptide
KCCEYCCTPACTGCY

SEQ ID NO: 949 - protein, 14 aa, Artificial Sequence
  Synthetically generated peptide
  misc_feature (14)..(14): Xaa can be Cys or D-Cys
KCCEYCCTPACTGX

SEQ ID NO: 950 - protein, 15 aa, Artificial Sequence
  Synthetically generated peptide
  misc_feature (14)..(14): Xaa can be Cys or D-Cys
KCCEYCCTPACTGXK

SEQ ID NO: 951 - protein, 15 aa, Artificial Sequence
  Synthetically generated peptide
  misc_feature (14)..(14): Xaa can be Cys or D-Cys
KCCEYCCTPACTGXY

SEQ ID NO: 952 - protein, 14 aa, Artificial Sequence
  Synthetically generated peptide
  misc_feature (6)..(6): Xaa can be Cys or D-Cys
KCCEYXCNPACTGC

SEQ ID NO: 953 - protein, 15 aa, Artificial Sequence
  Synthetically generated peptide
  misc_feature (6)..(6): Xaa can be Cys or D-Cys
KCCEYXCNPACTGCK

SEQ ID NO: 954 - protein, 15 aa, Artificial Sequence
  Synthetically generated peptide
  misc_feature (6)..(6): Xaa can be Cys or D-Cys
KCCEYXCNPACTGCY

SEQ ID NO: 955 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
KCCEYXCNPACTGX

SEQ ID NO: 956 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
KCCEYXCNPACTGXK

SEQ ID NO: 957 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
KCCEYXCNPACTGXY

SEQ ID NO: 958 - protein, 14 aa, Artificial Sequence
  Synthetically generated peptide
  misc_feature (6)..(6): Xaa can be Cys or D-Cys
KCCEYXCTPACTGC

SEQ ID NO: 959 - protein, 15 aa, Artificial Sequence
  Synthetically generated peptide
  misc_feature (6)..(6): Xaa can be Cys or D-Cys
KCCEYXCTPACTGCK

SEQ ID NO: 960 - protein, 15 aa, Artificial Sequence
  Synthetically generated peptide
  misc_feature (6)..(6): Xaa can be Cys or D-Cys
KCCEYXCTPACTGCY

SEQ ID NO: 961 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
KCCEYXCTPACTGX

SEQ ID NO: 962 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
KCCEYXCTPACTGXK

SEQ ID NO: 963 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
KCCEYXCTPACTGXY

SEQ ID NO: 964 - protein, 14 aa, Artificial Sequence
  Synthetically generated peptide
KCCEFCCNPACTGC

SEQ ID NO: 965 - protein, 15 aa, Artificial Sequence
  Synthetically generated peptide
KCCEFCCNPACTGCK

SEQ ID NO: 966 - protein, 15 aa, Artificial Sequence
  Synthetically generated peptide
KCCEFCCNPACTGCY

SEQ ID NO: 967 - protein, 14 aa, Artificial Sequence
  Synthetically generated peptide
  misc_feature (14)..(14): Xaa can be Cys or D-Cys
KCCEFCCNPACTGX

SEQ ID NO: 968 - protein, 15 aa, Artificial Sequence
  Synthetically generated peptide
  misc_feature (14)..(14): Xaa can be Cys or D-Cys
KCCEFCCNPACTGXK

SEQ ID NO: 969 - protein, 15 aa, Artificial Sequence
  Synthetically generated peptide
  misc_feature (14)..(14): Xaa can be Cys or D-Cys
KCCEFCCNPACTGXY

SEQ ID NO: 970 - protein, 14 aa, Artificial Sequence
  Synthetically generated peptide
KCCEFCCTPACTGC

SEQ ID NO: 971 - protein, 15 aa, Artificial Sequence
  Synthetically generated peptide
KCCEFCCTPACTGCK

SEQ ID NO: 972 - protein, 15 aa, Artificial Sequence
  Synthetically generated peptide
KCCEFCCTPACTGCY

SEQ ID NO: 973 - protein, 14 aa, Artificial Sequence
  Synthetically generated peptide
  misc_feature (14)..(14): Xaa can be Cys or D-Cys
KCCEFCCTPACTGX

SEQ ID NO: 974 - protein, 15 aa, Artificial Sequence
  Synthetically generated peptide
  misc_feature (14)..(14): Xaa can be Cys or D-Cys
KCCEFCCTPACTGXK

SEQ ID NO: 975 - protein, 15 aa, Artificial Sequence
  Synthetically generated peptide
  misc_feature (14)..(14): Xaa can be Cys or D-Cys
KCCEFCCTPACTGXY

SEQ ID NO: 976 - protein, 14 aa, Artificial Sequence
  Synthetically generated peptide
  misc_feature (6)..(6): Xaa can be Cys or D-Cys
KCCEFXCNPACTGC

SEQ ID NO: 977 - protein, 15 aa, Artificial Sequence
  Synthetically generated peptide
  misc_feature (6)..(6): Xaa can be Cys or D-Cys
KCCEFXCNPACTGCK

SEQ ID NO: 978 - protein, 15 aa, Artificial Sequence
  Synthetically generated peptide
  misc_feature (6)..(6): Xaa can be Cys or D-Cys
KCCEFXCNPACTGCY

SEQ ID NO: 979 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
KCCEFXCNPACTGX

SEQ ID NO: 980 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
KCCEFXCNPACTGXK

SEQ ID NO: 981 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
KCCEFXCNPACTGXY

SEQ ID NO: 982 - protein, 14 aa, Artificial Sequence
  Synthetically generated peptide
  misc_feature (6)..(6): Xaa can be Cys or D-Cys
KCCEFXCTPACTGC

SEQ ID NO: 983 - protein, 15 aa, Artificial Sequence
  Synthetically generated peptide
  misc_feature (6)..(6): Xaa can be Cys or D-Cys
KCCEFXCTPACTGCK

SEQ ID NO: 984 - protein, 15 aa, Artificial Sequence
  Synthetically generated peptide
  misc_feature (6)..(6): Xaa can be Cys or D-Cys
KCCEFXCTPACTGCY

SEQ ID NO: 985 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
KCCEFXCTPACTGX

SEQ ID NO: 986 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
KCCEFXCTPACTGXK

SEQ ID NO: 987 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
KCCEFXCTPACTGXY

SEQ ID NO: 988 - protein, 14 aa, Artificial Sequence
  Synthetically generated peptide
KCCEWCCNPACTGC

SEQ ID NO: 989 - protein, 15 aa, Artificial Sequence
  Synthetically generated peptide
KCCEWCCNPACTGCK

SEQ ID NO: 990 - protein, 15 aa, Artificial Sequence
  Synthetically generated peptide
KCCEWCCNPACTGCY

SEQ ID NO: 991 - protein, 14 aa, Artificial Sequence
  Synthetically generated peptide
  misc_feature (14)..(14): Xaa can be Cys or D-Cys
KCCEWCCNPACTGX

SEQ ID NO: 992 - protein, 15 aa, Artificial Sequence
  Synthetically generated peptide
  misc_feature (14)..(14): Xaa can be Cys or D-Cys
KCCEWCCNPACTGXK

SEQ ID NO: 993 - protein, 15 aa, Artificial Sequence
  Synthetically generated peptide
  misc_feature (14)..(14): Xaa can be Cys or D-Cys
KCCEWCCNPACTGXY

SEQ ID NO: 994 - protein, 14 aa, Artificial Sequence
  Synthetically generated peptide
KCCEWCCTPACTGC

SEQ ID NO: 995 - protein, 15 aa, Artificial Sequence
  Synthetically generated peptide
KCCEWCCTPACTGCK

SEQ ID NO: 996 - protein, 15 aa, Artificial Sequence
  Synthetically generated peptide
KCCEWCCTPACTGCY

SEQ ID NO: 997 - protein, 14 aa, Artificial Sequence
  Synthetically generated peptide
  misc_feature (14)..(14): Xaa can be Cys or D-Cys
KCCEWCCTPACTGX

SEQ ID NO: 998 - protein, 15 aa, Artificial Sequence
  Synthetically generated peptide
  misc_feature (14)..(14): Xaa can be Cys or D-Cys
KCCEWCCTPACTGXK

SEQ ID NO: 999 - protein, 15 aa, Artificial Sequence
  Synthetically generated peptide
  misc_feature (14)..(14): Xaa can be Cys or D-Cys
KCCEWCCTPACTGXY

SEQ ID NO: 1000 - protein, 14 aa, Artificial Sequence
  Synthetically generated peptide
  misc_feature (6)..(6): Xaa can be Cys or D-Cys
KCCEWXCNPACTGC

SEQ ID NO: 1001 - protein, 15 aa, Artificial Sequence
  Synthetically generated peptide
  misc_feature (6)..(6): Xaa can be Cys or D-Cys
KCCEWXCNPACTGCK

SEQ ID NO: 1002 - protein, 15 aa, Artificial Sequence
  Synthetically generated peptide
  misc_feature (6)..(6): Xaa can be Cys or D-Cys
KCCEWXCNPACTGCY

SEQ ID NO: 1003 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
KCCEWXCNPACTGX

SEQ ID NO: 1004 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
KCCEWXCNPACTGXK

SEQ ID NO: 1005 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
KCCEWXCNPACTGXY

SEQ ID NO: 1006 - protein, 14 aa, Artificial Sequence
  Synthetically generated peptide
  misc_feature (6)..(6): Xaa can be Cys or D-Cys
KCCEWXCTPACTGC

SEQ ID NO: 1007 - protein, 15 aa, Artificial Sequence
  Synthetically generated peptide
  misc_feature (6)..(6): Xaa can be Cys or D-Cys
KCCEWXCTPACTGCK

SEQ ID NO: 1008 - protein, 15 aa, Artificial Sequence
  Synthetically generated peptide
  misc_feature (6)..(6): Xaa can be Cys or D-Cys
KCCEWXCTPACTGCY

SEQ ID NO: 1009 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
KCCEWXCTPACTGX

SEQ ID NO: 1010 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
KCCEWXCTPACTGXK

SEQ ID NO: 1011 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
KCCEWXCTPACTGXY

SEQ ID NO: 1012 - protein, 14 aa, Artificial Sequence
  Synthetically generated peptide
  misc_feature (2)..(2): Xaa can be Cys or D-Cys
KXCEVCCNPACTGC

SEQ ID NO: 1013 - protein, 15 aa, Artificial Sequence
  Synthetically generated peptide
  misc_feature (2)..(2): Xaa can be Cys or D-Cys
KXCEVCCNPACTGCK

SEQ ID NO: 1014 - protein, 15 aa, Artificial Sequence
  Synthetically generated peptide
  misc_feature (2)..(2): Xaa can be Cys or D-Cys
KXCEVCCNPACTGCY

SEQ ID NO: 1015 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
KXCEVCCNPACTGX

SEQ ID NO: 1016 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
KXCEVCCNPACTGXK

SEQ ID NO: 1017 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
KXCEVCCNPACTGXY

SEQ ID NO: 1018 - protein, 14 aa, Artificial Sequence
  Synthetically generated peptide
  misc_feature (2)..(2): Xaa can be Cys or D-Cys
KXCEVCCTPACTGC

SEQ ID NO: 1019 - protein, 15 aa, Artificial Sequence
  Synthetically generated peptide
  misc_feature (2)..(2): Xaa can be Cys or D-Cys
KXCEVCCTPACTGCK

SEQ ID NO: 1020 - protein, 15 aa, Artificial Sequence
  Synthetically generated peptide
  misc_feature (2)..(2): Xaa can be Cys or D-Cys
KXCEVCCTPACTGCY

SEQ ID NO: 1021 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
KXCEVCCTPACTGX

SEQ ID NO: 1022 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
KXCEVCCTPACTGXK

SEQ ID NO: 1023 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
KXCEVCCTPACTGXY

SEQ ID NO: 1024 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
KXCEVXCNPACTGC

SEQ ID NO: 1025 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
KXCEVXCNPACTGCK

SEQ ID NO: 1026 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
KXCEVXCNPACTGCY

SEQ ID NO: 1027 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCEVXCNPACTGX

SEQ ID NO: 1028 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCEVXCNPACTGXK

SEQ ID NO: 1029 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCEVXCNPACTGXY

SEQ ID NO: 1030 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
KXCEVXCTPACTGC

SEQ ID NO: 1031 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
KXCEVXCTPACTGCK

SEQ ID NO: 1032 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
KXCEVXCTPACTGCY

SEQ ID NO: 1033 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCEVXCTPACTGX

SEQ ID NO: 1034 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCEVXCTPACTGXK

SEQ ID NO: 1035 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCEVXCTPACTGXY

SEQ ID NO: 1036 - protein, 14 aa, Artificial Sequence
  Synthetically generated peptide
  misc_feature (2)..(2): Xaa can be Cys or D-Cys
KXCEICCNPACTGC

SEQ ID NO: 1037 - protein, 15 aa, Artificial Sequence
  Synthetically generated peptide
  misc_feature (2)..(2): Xaa can be Cys or D-Cys
KXCEICCNPACTGCK

SEQ ID NO: 1038 - protein, 15 aa, Artificial Sequence
  Synthetically generated peptide
  misc_feature (2)..(2): Xaa can be Cys or D-Cys
KXCEICCNPACTGCY

SEQ ID NO: 1039 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
KXCEICCNPACTGX

SEQ ID NO: 1040 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
KXCEICCNPACTGXK

SEQ ID NO: 1041 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
KXCEICCNPACTGXY

SEQ ID NO: 1042 - protein, 14 aa, Artificial Sequence
  Synthetically generated peptide
  misc_feature (2)..(2): Xaa can be Cys or D-Cys
KXCEICCTPACTGC

SEQ ID NO: 1043 - protein, 15 aa, Artificial Sequence
  Synthetically generated peptide
  misc_feature (2)..(2): Xaa can be Cys or D-Cys
KXCEICCTPACTGCK

SEQ ID NO: 1044 - protein, 15 aa, Artificial Sequence
  Synthetically generated peptide
  misc_feature (2)..(2): Xaa can be Cys or D-Cys
KXCEICCTPACTGCY

SEQ ID NO: 1045 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
KXCEICCTPACTGX

SEQ ID NO: 1046 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
KXCEICCTPACTGXK

SEQ ID NO: 1047 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
KXCEICCTPACTGXY

SEQ ID NO: 1048 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
KXCEIXCNPACTGC

SEQ ID NO: 1049 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
KXCEIXCNPACTGCK

SEQ ID NO: 1050 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
KXCEIXCNPACTGCY

SEQ ID NO: 1051 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCEIXCNPACTGX

SEQ ID NO: 1052 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCEIXCNPACTGXK

SEQ ID NO: 1053 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCEIXCNPACTGXY

SEQ ID NO: 1054 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
KXCEIXCTPACTGC

SEQ ID NO: 1055 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
KXCEIXCTPACTGCK

SEQ ID NO: 1056 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
KXCEIXCTPACTGCY

SEQ ID NO: 1057 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCEIXCTPACTGX

SEQ ID NO: 1058 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCEIXCTPACTGXK

SEQ ID NO: 1059 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCEIXCTPACTGXY

SEQ ID NO: 1060 - protein, 14 aa, Artificial Sequence
  Synthetically generated peptide
  misc_feature (2)..(2): Xaa can be Cys or D-Cys
KXCELCCNPACTGC

SEQ ID NO: 1061 - protein, 15 aa, Artificial Sequence
  Synthetically generated peptide
  misc_feature (2)..(2): Xaa can be Cys or D-Cys
KXCELCCNPACTGCK

SEQ ID NO: 1062 - protein, 15 aa, Artificial Sequence
  Synthetically generated peptide
  misc_feature (2)..(2): Xaa can be Cys or D-Cys
KXCELCCNPACTGCY

SEQ ID NO: 1063 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
KXCELCCNPACTGX

SEQ ID NO: 1064 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
KXCELCCNPACTGXK

SEQ ID NO: 1065 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
KXCELCCNPACTGXY

SEQ ID NO: 1066 - protein, 14 aa, Artificial Sequence
  Synthetically generated peptide
  misc_feature (2)..(2): Xaa can be Cys or D-Cys
KXCELCCTPACTGC

SEQ ID NO: 1067 - protein, 15 aa, Artificial Sequence
  Synthetically generated peptide
  misc_feature (2)..(2): Xaa can be Cys or D-Cys
KXCELCCTPACTGCK

SEQ ID NO: 1068 - protein, 15 aa, Artificial Sequence
  Synthetically generated peptide
  misc_feature (2)..(2): Xaa can be Cys or D-Cys
KXCELCCTPACTGCY

SEQ ID NO: 1069 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
KXCELCCTPACTGX

SEQ ID NO: 1070 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
KXCELCCTPACTGXK

SEQ ID NO: 1071 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
KXCELCCTPACTGXY

SEQ ID NO: 1072 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
KXCELXCNPACTGC

SEQ ID NO: 1073 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
KXCELXCNPACTGCK

SEQ ID NO: 1074 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
KXCELXCNPACTGCY

SEQ ID NO: 1075 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCELXCNPACTGX

SEQ ID NO: 1076 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCELXCNPACTGXK

SEQ ID NO: 1077 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCELXCNPACTGXY

SEQ ID NO: 1078 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
KXCELXCTPACTGC

SEQ ID NO: 1079 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
KXCELXCTPACTGCK

SEQ ID NO: 1080 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
KXCELXCTPACTGCY

SEQ ID NO: 1081 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCELXCTPACTGX

SEQ ID NO: 1082 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCELXCTPACTGXK

SEQ ID NO: 1083 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCELXCTPACTGXY

SEQ ID NO: 1084 - protein, 14 aa, Artificial Sequence
  Synthetically generated peptide
  misc_feature (2)..(2): Xaa can be Cys or D-Cys
KXCEYCCNPACTGC

SEQ ID NO: 1085 - protein, 15 aa, Artificial Sequence
  Synthetically generated peptide
  misc_feature (2)..(2): Xaa can be Cys or D-Cys
KXCEYCCNPACTGCK

SEQ ID NO: 1086 - protein, 15 aa, Artificial Sequence
  Synthetically generated peptide
  misc_feature (2)..(2): Xaa can be Cys or D-Cys
KXCEYCCNPACTGCY

SEQ ID NO: 1087 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
KXCEYCCNPACTGX

SEQ ID NO: 1088 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
KXCEYCCNPACTGXK

SEQ ID NO: 1089 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
KXCEYCCNPACTGXY

SEQ ID NO: 1090 - protein, 14 aa, Artificial Sequence
  Synthetically generated peptide
  misc_feature (2)..(2): Xaa can be Cys or D-Cys
KXCEYCCTPACTGC

SEQ ID NO: 1091 - protein, 15 aa, Artificial Sequence
  Synthetically generated peptide
  misc_feature (2)..(2): Xaa can be Cys or D-Cys
KXCEYCCTPACTGCK

SEQ ID NO: 1092 - protein, 15 aa, Artificial Sequence
  Synthetically generated peptide
  misc_feature (2)..(2): Xaa can be Cys or D-Cys
KXCEYCCTPACTGCY

SEQ ID NO: 1093 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
KXCEYCCTPACTGX

SEQ ID NO: 1094 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
KXCEYCCTPACTGXK

SEQ ID NO: 1095 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
KXCEYCCTPACTGXY

SEQ ID NO: 1096 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
KXCEYXCNPACTGC

SEQ ID NO: 1097 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
KXCEYXCNPACTGCK

SEQ ID NO: 1098 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
KXCEYXCNPACTGCY

SEQ ID NO: 1099 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCEYXCNPACTGX

SEQ ID NO: 1100 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCEYXCNPACTGXK

SEQ ID NO: 1101 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCEYXCNPACTGXY

SEQ ID NO: 1102 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
KXCEYXCTPACTGC

SEQ ID NO: 1103 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
KXCEYXCTPACTGCK

SEQ ID NO: 1104 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
KXCEYXCTPACTGCY

SEQ ID NO: 1105 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCEYXCTPACTGX

SEQ ID NO: 1106 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCEYXCTPACTGXK

SEQ ID NO: 1107 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCEYXCTPACTGXY

SEQ ID NO: 1108 - protein, 14 aa, Artificial Sequence
  Synthetically generated peptide
  misc_feature (2)..(2): Xaa can be Cys or D-Cys
KXCEFCCNPACTGC

SEQ ID NO: 1109 - protein, 15 aa, Artificial Sequence
  Synthetically generated peptide
  misc_feature (2)..(2): Xaa can be Cys or D-Cys
KXCEFCCNPACTGCK

SEQ ID NO: 1110 - protein, 15 aa, Artificial Sequence
  Synthetically generated peptide
  misc_feature (2)..(2): Xaa can be Cys or D-Cys
KXCEFCCNPACTGCY

SEQ ID NO: 1111 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
KXCEFCCNPACTGX

SEQ ID NO: 1112 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
KXCEFCCNPACTGXK

SEQ ID NO: 1113 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
KXCEFCCNPACTGXY

SEQ ID NO: 1114 - protein, 14 aa, Artificial Sequence
  Synthetically generated peptide
  misc_feature (2)..(2): Xaa can be Cys or D-Cys
KXCEFCCTPACTGC

SEQ ID NO: 1115 - protein, 15 aa, Artificial Sequence
  Synthetically generated peptide
  misc_feature (2)..(2): Xaa can be Cys or D-Cys
KXCEFCCTPACTGCK

SEQ ID NO: 1116 - protein, 15 aa, Artificial Sequence
  Synthetically generated peptide
  misc_feature (2)..(2): Xaa can be Cys or D-Cys
KXCEFCCTPACTGCY

SEQ ID NO: 1117 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
KXCEFCCTPACTGX

SEQ ID NO: 1118 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
KXCEFCCTPACTGXK

SEQ ID NO: 1119 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
KXCEFCCTPACTGXY

SEQ ID NO: 1120 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
KXCEFXCNPACTGC

SEQ ID NO: 1121 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
KXCEFXCNPACTGCK

SEQ ID NO: 1122 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
KXCEFXCNPACTGCY

SEQ ID NO: 1123 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCEFXCNPACTGX

SEQ ID NO: 1124 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCEFXCNPACTGXK

SEQ ID NO: 1125 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCEFXCNPACTGXY

SEQ ID NO: 1126 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
KXCEFXCTPACTGC

SEQ ID NO: 1127 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
KXCEFXCTPACTGCK

SEQ ID NO: 1128 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
KXCEFXCTPACTGCY

SEQ ID NO: 1129 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCEFXCTPACTGX

SEQ ID NO: 1130 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCEFXCTPACTGXK

SEQ ID NO: 1131 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCEFXCTPACTGXY

SEQ ID NO: 1132 - protein, 14 aa, Artificial Sequence
  Synthetically generated peptide
  misc_feature (2)..(2): Xaa can be Cys or D-Cys
KXCEWCCNPACTGC

SEQ ID NO: 1133 - protein, 15 aa, Artificial Sequence
  Synthetically generated peptide
  misc_feature (2)..(2): Xaa can be Cys or D-Cys
KXCEWCCNPACTGCK

SEQ ID NO: 1134 - protein, 15 aa, Artificial Sequence
  Synthetically generated peptide
  misc_feature (2)..(2): Xaa can be Cys or D-Cys
KXCEWCCNPACTGCY

SEQ ID NO: 1135 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
KXCEWCCNPACTGX

SEQ ID NO: 1136 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
KXCEWCCNPACTGXK

SEQ ID NO: 1137 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
KXCEWCCNPACTGXY

SEQ ID NO: 1138 - protein, 14 aa, Artificial Sequence
  Synthetically generated peptide
  misc_feature (2)..(2): Xaa can be Cys or D-Cys
KXCEWCCTPACTGC

SEQ ID NO: 1139 - protein, 15 aa, Artificial Sequence
  Synthetically generated peptide
  misc_feature (2)..(2): Xaa can be Cys or D-Cys
KXCEWCCTPACTGCK

SEQ ID NO: 1140 - protein, 15 aa, Artificial Sequence
  Synthetically generated peptide
  misc_feature (2)..(2): Xaa can be Cys or D-Cys
KXCEWCCTPACTGCY

SEQ ID NO: 1141 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
KXCEWCCTPACTGX

SEQ ID NO: 1142 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
KXCEWCCTPACTGXK

SEQ ID NO: 1143 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
KXCEWCCTPACTGXY

SEQ ID NO: 1144 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
KXCEWXCNPACTGC

SEQ ID NO: 1145 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
KXCEWXCNPACTGCK

SEQ ID NO: 1146 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
KXCEWXCNPACTGCY

SEQ ID NO: 1147 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCEWXCNPACTGX

SEQ ID NO: 1148 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCEWXCNPACTGXK

SEQ ID NO: 1149 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCEWXCNPACTGXY

SEQ ID NO: 1150 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
KXCEWXCTPACTGC

SEQ ID NO: 1151 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
KXCEWXCTPACTGCK

SEQ ID NO: 1152 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
KXCEWXCTPACTGCY

SEQ ID NO: 1153 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCEWXCTPACTGX

SEQ ID NO: 1154 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCEWXCTPACTGXK

SEQ ID NO: 1155 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
KXCEWXCTPACTGXY

SEQ ID NO: 1156 - protein, 14 aa, Artificial Sequence
  Synthetically generated peptide
SCCEVCCNPACTGC

SEQ ID NO: 1157 - protein, 15 aa, Artificial Sequence
  Synthetically generated peptide
SCCEVCCNPACTGCK

SEQ ID NO: 1158 - protein, 15 aa, Artificial Sequence
  Synthetically generated peptide
SCCEVCCNPACTGCY

SEQ ID NO: 1159 - protein, 14 aa, Artificial Sequence
  Synthetically generated peptide
  misc_feature (14)..(14): Xaa can be Cys or D-Cys
SCCEVCCNPACTGX

SEQ ID NO: 1160 - protein, 15 aa, Artificial Sequence
  Synthetically generated peptide
  misc_feature (14)..(14): Xaa can be Cys or D-Cys
SCCEVCCNPACTGXK

SEQ ID NO: 1161 - protein, 15 aa, Artificial Sequence
  Synthetically generated peptide
  misc_feature (14)..(14): Xaa can be Cys or D-Cys
SCCEVCCNPACTGXY

SEQ ID NO: 1162 - protein, 14 aa, Artificial Sequence
  Synthetically generated peptide
SCCEVCCTPACTGC

SEQ ID NO: 1163 - protein, 15 aa, Artificial Sequence
  Synthetically generated peptide
SCCEVCCTPACTGCK

SEQ ID NO: 1164 - protein, 15 aa, Artificial Sequence
  Synthetically generated peptide
SCCEVCCTPACTGCY

SEQ ID NO: 1165 - protein, 14 aa, Artificial Sequence
  Synthetically generated peptide
  misc_feature (14)..(14): Xaa can be Cys or D-Cys
SCCEVCCTPACTGX

SEQ ID NO: 1166 - protein, 15 aa, Artificial Sequence
  Synthetically generated peptide
  misc_feature (14)..(14): Xaa can be Cys or D-Cys
SCCEVCCTPACTGXK

SEQ ID NO: 1167 - protein, 15 aa, Artificial Sequence
  Synthetically generated peptide
  misc_feature (14)..(14): Xaa can be Cys or D-Cys
SCCEVCCTPACTGXY

SEQ ID NO: 1168 - protein, 14 aa, Artificial Sequence
  Synthetically generated peptide
  misc_feature (6)..(6): Xaa can be Cys or D-Cys
SCCEVXCNPACTGC

SEQ ID NO: 1169 - protein, 15 aa, Artificial Sequence
  Synthetically generated peptide
  misc_feature (6)..(6): Xaa can be Cys or D-Cys
SCCEVXCNPACTGCK

SEQ ID NO: 1170 - protein, 15 aa, Artificial Sequence
  Synthetically generated peptide
  misc_feature (6)..(6): Xaa can be Cys or D-Cys
SCCEVXCNPACTGCY

SEQ ID NO: 1171 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
SCCEVXCNPACTGX

SEQ ID NO: 1172 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
SCCEVXCNPACTGXK

SEQ ID NO: 1173 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
SCCEVXCNPACTGXY

SEQ ID NO: 1174 - protein, 14 aa, Artificial Sequence
  Synthetically generated peptide
  misc_feature (6)..(6): Xaa can be Cys or D-Cys
SCCEVXCTPACTGC

SEQ ID NO: 1175 - protein, 15 aa, Artificial Sequence
  Synthetically generated peptide
  misc_feature (6)..(6): Xaa can be Cys or D-Cys
SCCEVXCTPACTGCK

SEQ ID NO: 1176 - protein, 15 aa, Artificial Sequence
  Synthetically generated peptide
  misc_feature (6)..(6): Xaa can be Cys or D-Cys
SCCEVXCTPACTGCY

SEQ ID NO: 1177 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
SCCEVXCTPACTGX

SEQ ID NO: 1178 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
SCCEVXCTPACTGXK

SEQ ID NO: 1179 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
SCCEVXCTPACTGXY

SEQ ID NO: 1180 - protein, 14 aa, Artificial Sequence
  Synthetically generated peptide
SCCEICCNPACTGC

SEQ ID NO: 1181 - protein, 15 aa, Artificial Sequence
  Synthetically generated peptide
SCCEICCNPACTGCK

SEQ ID NO: 1182 - protein, 15 aa, Artificial Sequence
  Synthetically generated peptide
SCCEICCNPACTGCY

SEQ ID NO: 1183 - protein, 14 aa, Artificial Sequence
  Synthetically generated peptide
  misc_feature (14)..(14): Xaa can be Cys or D-Cys
SCCEICCNPACTGX

SEQ ID NO: 1184 - protein, 15 aa, Artificial Sequence
  Synthetically generated peptide
  misc_feature (14)..(14): Xaa can be Cys or D-Cys
SCCEICCNPACTGXK

SEQ ID NO: 1185 - protein, 15 aa, Artificial Sequence
  Synthetically generated peptide
  misc_feature (14)..(14): Xaa can be Cys or D-Cys
SCCEICCNPACTGXY

SEQ ID NO: 1186 - protein, 14 aa, Artificial Sequence
  Synthetically generated peptide
SCCEICCTPACTGC

SEQ ID NO: 1187 - protein, 15 aa, Artificial Sequence
  Synthetically generated peptide
SCCEICCTPACTGCK

SEQ ID NO: 1188 - protein, 15 aa, Artificial Sequence
  Synthetically generated peptide
SCCEICCTPACTGCY

SEQ ID NO: 1189 - protein, 14 aa, Artificial Sequence
  Synthetically generated peptide
  misc_feature (14)..(14): Xaa can be Cys or D-Cys
SCCEICCTPACTGX

SEQ ID NO: 1190 - protein, 15 aa, Artificial Sequence
  Synthetically generated peptide
  misc_feature (14)..(14): Xaa can be Cys or D-Cys
SCCEICCTPACTGXK

SEQ ID NO: 1191 - protein, 15 aa, Artificial Sequence
  Synthetically generated peptide
  misc_feature (14)..(14): Xaa can be Cys or D-Cys
SCCEICCTPACTGXY

SEQ ID NO: 1192 - protein, 14 aa, Artificial Sequence
  Synthetically generated peptide
  misc_feature (6)..(6): Xaa can be Cys or D-Cys
SCCEIXCNPACTGC

SEQ ID NO: 1193 - protein, 15 aa, Artificial Sequence
  Synthetically generated peptide
  misc_feature (6)..(6): Xaa can be Cys or D-Cys
SCCEIXCNPACTGCK

SEQ ID NO: 1194 - protein, 15 aa, Artificial Sequence
  Synthetically generated peptide
  misc_feature (6)..(6): Xaa can be Cys or D-Cys
SCCEIXCNPACTGCY

SEQ ID NO: 1195 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
SCCEIXCNPACTGX

SEQ ID NO: 1196 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
SCCEIXCNPACTGXK

SEQ ID NO: 1197 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
SCCEIXCNPACTGXY

SEQ ID NO: 1198 - protein, 14 aa, Artificial Sequence
  Synthetically generated peptide
  misc_feature (6)..(6): Xaa can be Cys or D-Cys
SCCEIXCTPACTGC

SEQ ID NO: 1199 - protein, 15 aa, Artificial Sequence
  Synthetically generated peptide
  misc_feature (6)..(6): Xaa can be Cys or D-Cys
SCCEIXCTPACTGCK

SEQ ID NO: 1200 - protein, 15 aa, Artificial Sequence
  Synthetically generated peptide
  misc_feature (6)..(6): Xaa can be Cys or D-Cys
SCCEIXCTPACTGCY

SEQ ID NO: 1201 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
SCCEIXCTPACTGX

SEQ ID NO: 1202 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
SCCEIXCTPACTGXK

SEQ ID NO: 1203 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
SCCEIXCTPACTGXY

SEQ ID NO: 1204 - protein, 14 aa, Artificial Sequence
  Synthetically generated peptide
SCCELCCNPACTGC

SEQ ID NO: 1205 - protein, 15 aa, Artificial Sequence
  Synthetically generated peptide
SCCELCCNPACTGCK

SEQ ID NO: 1206 - protein, 15 aa, Artificial Sequence
  Synthetically generated peptide
SCCELCCNPACTGCY

SEQ ID NO: 1207 - protein, 14 aa, Artificial Sequence
  Synthetically generated peptide
  misc_feature (14)..(14): Xaa can be Cys or D-Cys
SCCELCCNPACTGX

SEQ ID NO: 1208 - protein, 15 aa, Artificial Sequence
  Synthetically generated peptide
  misc_feature (14)..(14): Xaa can be Cys or D-Cys
SCCELCCNPACTGXK

SEQ ID NO: 1209 - protein, 15 aa, Artificial Sequence
  Synthetically generated peptide
  misc_feature (14)..(14): Xaa can be Cys or D-Cys
SCCELCCNPACTGXY

SEQ ID NO: 1210 - protein, 14 aa, Artificial Sequence
  Synthetically generated peptide
SCCELCCTPACTGC

SEQ ID NO: 1211 - protein, 15 aa, Artificial Sequence
  Synthetically generated peptide
SCCELCCTPACTGCK

SEQ ID NO: 1212 - protein, 15 aa, Artificial Sequence
  Synthetically generated peptide
SCCELCCTPACTGCY

SEQ ID NO: 1213 - protein, 14 aa, Artificial Sequence
  Synthetically generated peptide
  misc_feature (14)..(14): Xaa can be Cys or D-Cys
SCCELCCTPACTGX

SEQ ID NO: 1214 - protein, 15 aa, Artificial Sequence
  Synthetically generated peptide
  misc_feature (14)..(14): Xaa can be Cys or D-Cys
SCCELCCTPACTGXK

SEQ ID NO: 1215 - protein, 15 aa, Artificial Sequence
  Synthetically generated peptide
  misc_feature (14)..(14): Xaa can be Cys or D-Cys
SCCELCCTPACTGXY

SEQ ID NO: 1216 - protein, 14 aa, Artificial Sequence
  Synthetically generated peptide
  misc_feature (6)..(6): Xaa can be Cys or D-Cys
SCCELXCNPACTGC

SEQ ID NO: 1217 - protein, 15 aa, Artificial Sequence
  Synthetically generated peptide
  misc_feature (6)..(6): Xaa can be Cys or D-Cys
SCCELXCNPACTGCK

SEQ ID NO: 1218 - protein, 15 aa, Artificial Sequence
  Synthetically generated peptide
  misc_feature (6)..(6): Xaa can be Cys or D-Cys
SCCELXCNPACTGCY

SEQ ID NO: 1219 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
SCCELXCNPACTGX

SEQ ID NO: 1220 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
SCCELXCNPACTGXK

SEQ ID NO: 1221 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
SCCELXCNPACTGXY

SEQ ID NO: 1222 - protein, 14 aa, Artificial Sequence
  Synthetically generated peptide
  misc_feature (6)..(6): Xaa can be Cys or D-Cys
SCCELXCTPACTGC

SEQ ID NO: 1223 - protein, 15 aa, Artificial Sequence
  Synthetically generated peptide
  misc_feature (6)..(6): Xaa can be Cys or D-Cys
SCCELXCTPACTGCK

SEQ ID NO: 1224 - protein, 15 aa, Artificial Sequence
  Synthetically generated peptide
  misc_feature (6)..(6): Xaa can be Cys or D-Cys
SCCELXCTPACTGCY

SEQ ID NO: 1225 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
SCCELXCTPACTGX

SEQ ID NO: 1226 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
SCCELXCTPACTGXK

SEQ ID NO: 1227 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
SCCELXCTPACTGXY

SEQ ID NO: 1228 - protein, 14 aa, Artificial Sequence
  Synthetically generated peptide
SCCEYCCNPACTGC

SEQ ID NO: 1229 - protein, 15 aa, Artificial Sequence
  Synthetically generated peptide
SCCEYCCNPACTGCK

SEQ ID NO: 1230 - protein, 15 aa, Artificial Sequence
  Synthetically generated peptide
SCCEYCCNPACTGCY

SEQ ID NO: 1231 - protein, 14 aa, Artificial Sequence
  Synthetically generated peptide
  misc_feature (14)..(14): Xaa can be Cys or D-Cys
SCCEYCCNPACTGX

SEQ ID NO: 1232 - protein, 15 aa, Artificial Sequence
  Synthetically generated peptide
  misc_feature (14)..(14): Xaa can be Cys or D-Cys
SCCEYCCNPACTGXK

SEQ ID NO: 1233 - protein, 15 aa, Artificial Sequence
  Synthetically generated peptide
  misc_feature (14)..(14): Xaa can be Cys or D-Cys
SCCEYCCNPACTGXY

SEQ ID NO: 1234 - protein, 14 aa, Artificial Sequence
  Synthetically generated peptide
SCCEYCCTPACTGC

SEQ ID NO: 1235 - protein, 15 aa, Artificial Sequence
  Synthetically generated peptide
SCCEYCCTPACTGCK

SEQ ID NO: 1236 - protein, 15 aa, Artificial Sequence
  Synthetically generated peptide
SCCEYCCTPACTGCY

SEQ ID NO: 1237 - protein, 14 aa, Artificial Sequence
  Synthetically generated peptide
  misc_feature (14)..(14): Xaa can be Cys or D-Cys
SCCEYCCTPACTGX

SEQ ID NO: 1238 - protein, 15 aa, Artificial Sequence
  Synthetically generated peptide
  misc_feature (14)..(14): Xaa can be Cys or D-Cys
SCCEYCCTPACTGXK

SEQ ID NO: 1239 - protein, 15 aa, Artificial Sequence
  Synthetically generated peptide
  misc_feature (14)..(14): Xaa can be Cys or D-Cys
SCCEYCCTPACTGXY

SEQ ID NO: 1240 - protein, 14 aa, Artificial Sequence
  Synthetically generated peptide
  misc_feature (6)..(6): Xaa can be Cys or D-Cys
SCCEYXCNPACTGC

SEQ ID NO: 1241 - protein, 15 aa, Artificial Sequence
  Synthetically generated peptide
  misc_feature (6)..(6): Xaa can be Cys or D-Cys
SCCEYXCNPACTGCK

SEQ ID NO: 1242 - protein, 15 aa, Artificial Sequence
  Synthetically generated peptide
  misc_feature (6)..(6): Xaa can be Cys or D-Cys
SCCEYXCNPACTGCY

SEQ ID NO: 1243 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
SCCEYXCNPACTGX

SEQ ID NO: 1244 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
SCCEYXCNPACTGXK

SEQ ID NO: 1245 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
SCCEYXCNPACTGXY

SEQ ID NO: 1246 - protein, 14 aa, Artificial Sequence
  Synthetically generated peptide
  misc_feature (6)..(6): Xaa can be Cys or D-Cys
SCCEYXCTPACTGC

SEQ ID NO: 1247 - protein, 15 aa, Artificial Sequence
  Synthetically generated peptide
  misc_feature (6)..(6): Xaa can be Cys or D-Cys
SCCEYXCTPACTGCK

SEQ ID NO: 1248 - protein, 15 aa, Artificial Sequence
  Synthetically generated peptide
  misc_feature (6)..(6): Xaa can be Cys or D-Cys
SCCEYXCTPACTGCY

SEQ ID NO: 1249 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
SCCEYXCTPACTGX

SEQ ID NO: 1250 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
SCCEYXCTPACTGXK

SEQ ID NO: 1251 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
SCCEYXCTPACTGXY

SEQ ID NO: 1252 - protein, 14 aa, Artificial Sequence
  Synthetically generated peptide
SCCEFCCNPACTGC

SEQ ID NO: 1253 - protein, 15 aa, Artificial Sequence
  Synthetically generated peptide
SCCEFCCNPACTGCK

SEQ ID NO: 1254 - protein, 15 aa, Artificial Sequence
  Synthetically generated peptide
SCCEFCCNPACTGCY

SEQ ID NO: 1255 - protein, 14 aa, Artificial Sequence
  Synthetically generated peptide
  misc_feature (14)..(14): Xaa can be Cys or D-Cys
SCCEFCCNPACTGX

SEQ ID NO: 1256 - protein, 15 aa, Artificial Sequence
  Synthetically generated peptide
  misc_feature (14)..(14): Xaa can be Cys or D-Cys
SCCEFCCNPACTGXK

SEQ ID NO: 1257 - protein, 15 aa, Artificial Sequence
  Synthetically generated peptide
  misc_feature (14)..(14): Xaa can be Cys or D-Cys
SCCEFCCNPACTGXY

SEQ ID NO: 1258 - protein, 14 aa, Artificial Sequence
  Synthetically generated peptide
SCCEFCCTPACTGC

SEQ ID NO: 1259 - protein, 15 aa, Artificial Sequence
  Synthetically generated peptide
SCCEFCCTPACTGCK

SEQ ID NO: 1260 - protein, 15 aa, Artificial Sequence
  Synthetically generated peptide
SCCEFCCTPACTGCY

SEQ ID NO: 1261 - protein, 14 aa, Artificial Sequence
  Synthetically generated peptide
  misc_feature (14)..(14): Xaa can be Cys or D-Cys
SCCEFCCTPACTGX

SEQ ID NO: 1262 - protein, 15 aa, Artificial Sequence
  Synthetically generated peptide
  misc_feature (14)..(14): Xaa can be Cys or D-Cys
SCCEFCCTPACTGXK

SEQ ID NO: 1263 - protein, 15 aa, Artificial Sequence
  Synthetically generated peptide
  misc_feature (14)..(14): Xaa can be Cys or D-Cys
SCCEFCCTPACTGXY

SEQ ID NO: 1264 - protein, 14 aa, Artificial Sequence
  Synthetically generated peptide
  misc_feature (6)..(6): Xaa can be Cys or D-Cys
SCCEFXCNPACTGC

SEQ ID NO: 1265 - protein, 15 aa, Artificial Sequence
  Synthetically generated peptide
  misc_feature (6)..(6): Xaa can be Cys or D-Cys
SCCEFXCNPACTGCK

SEQ ID NO: 1266 - protein, 15 aa, Artificial Sequence
  Synthetically generated peptide
  misc_feature (6)..(6): Xaa can be Cys or D-Cys
SCCEFXCNPACTGCY

SEQ ID NO: 1267 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
SCCEFXCNPACTGX

SEQ ID NO: 1268 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
SCCEFXCNPACTGXK

SEQ ID NO: 1269 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
SCCEFXCNPACTGXY

SEQ ID NO: 1270 - protein, 14 aa, Artificial Sequence
  Synthetically generated peptide
  misc_feature (6)..(6): Xaa can be Cys or D-Cys
SCCEFXCTPACTGC

SEQ ID NO: 1271 - protein, 15 aa, Artificial Sequence
  Synthetically generated peptide
  misc_feature (6)..(6): Xaa can be Cys or D-Cys
SCCEFXCTPACTGCK

SEQ ID NO: 1272 - protein, 15 aa, Artificial Sequence
  Synthetically generated peptide
  misc_feature (6)..(6): Xaa can be Cys or D-Cys
SCCEFXCTPACTGCY

SEQ ID NO: 1273 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
SCCEFXCTPACTGX

SEQ ID NO: 1274 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
SCCEFXCTPACTGXK

SEQ ID NO: 1275 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
SCCEFXCTPACTGXY

SEQ ID NO: 1276 - protein, 14 aa, Artificial Sequence
  Synthetically generated peptide
SCCEWCCNPACTGC

SEQ ID NO: 1277 - protein, 15 aa, Artificial Sequence
  Synthetically generated peptide
SCCEWCCNPACTGCK

SEQ ID NO: 1278 - protein, 15 aa, Artificial Sequence
  Synthetically generated peptide
SCCEWCCNPACTGCY

SEQ ID NO: 1279 - protein, 14 aa, Artificial Sequence
  Synthetically generated peptide
  misc_feature (14)..(14): Xaa can be Cys or D-Cys
SCCEWCCNPACTGX

SEQ ID NO: 1280 - protein, 15 aa, Artificial Sequence
  Synthetically generated peptide
  misc_feature (14)..(14): Xaa can be Cys or D-Cys
SCCEWCCNPACTGXK

SEQ ID NO: 1281 - protein, 15 aa, Artificial Sequence
  Synthetically generated peptide
  misc_feature (14)..(14): Xaa can be Cys or D-Cys
SCCEWCCNPACTGXY

SEQ ID NO: 1282 - protein, 14 aa, Artificial Sequence
  Synthetically generated peptide
SCCEWCCTPACTGC

SEQ ID NO: 1283 - protein, 15 aa, Artificial Sequence
  Synthetically generated peptide
SCCEWCCTPACTGCK

SEQ ID NO: 1284 - protein, 15 aa, Artificial Sequence
  Synthetically generated peptide
SCCEWCCTPACTGCY

SEQ ID NO: 1285 - protein, 14 aa, Artificial Sequence
  Synthetically generated peptide
  misc_feature (14)..(14): Xaa can be Cys or D-Cys
SCCEWCCTPACTGX

SEQ ID NO: 1286 - protein, 15 aa, Artificial Sequence
  Synthetically generated peptide
  misc_feature (14)..(14): Xaa can be Cys or D-Cys
SCCEWCCTPACTGXK

SEQ ID NO: 1287 - protein, 15 aa, Artificial Sequence
  Synthetically generated peptide
  misc_feature (14)..(14): Xaa can be Cys or D-Cys
SCCEWCCTPACTGXY

SEQ ID NO: 1288 - protein, 14 aa, Artificial Sequence
  Synthetically generated peptide
  misc_feature (6)..(6): Xaa can be Cys or D-Cys
SCCEWXCNPACTGC

SEQ ID NO: 1289 - protein, 15 aa, Artificial Sequence
  Synthetically generated peptide
  misc_feature (6)..(6): Xaa can be Cys or D-Cys
SCCEWXCNPACTGCK

SEQ ID NO: 1290 - protein, 15 aa, Artificial Sequence
  Synthetically generated peptide
  misc_feature (6)..(6): Xaa can be Cys or D-Cys
SCCEWXCNPACTGCY

SEQ ID NO: 1291 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
SCCEWXCNPACTGX

SEQ ID NO: 1292 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
SCCEWXCNPACTGXK

SEQ ID NO: 1293 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
SCCEWXCNPACTGXY

SEQ ID NO: 1294 - protein, 14 aa, Artificial Sequence
  Synthetically generated peptide
  misc_feature (6)..(6): Xaa can be Cys or D-Cys
SCCEWXCTPACTGC

SEQ ID NO: 1295 - protein, 15 aa, Artificial Sequence
  Synthetically generated peptide
  misc_feature (6)..(6): Xaa can be Cys or D-Cys
SCCEWXCTPACTGCK

SEQ ID NO: 1296 - protein, 15 aa, Artificial Sequence
  Synthetically generated peptide
  misc_feature (6)..(6): Xaa can be Cys or D-Cys
SCCEWXCTPACTGCY

SEQ ID NO: 1297 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
SCCEWXCTPACTGX

SEQ ID NO: 1298 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
SCCEWXCTPACTGXK

SEQ ID NO: 1299 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
SCCEWXCTPACTGXY

SEQ ID NO: 1300 - protein, 14 aa, Artificial Sequence
  Synthetically generated peptide
  misc_feature (2)..(2): Xaa can be Cys or D-Cys
SXCEVCCNPACTGC

SEQ ID NO: 1301 - protein, 15 aa, Artificial Sequence
  Synthetically generated peptide
  misc_feature (2)..(2): Xaa can be Cys or D-Cys
SXCEVCCNPACTGCK

SEQ ID NO: 1302 - protein, 15 aa, Artificial Sequence
  Synthetically generated peptide
  misc_feature (2)..(2): Xaa can be Cys or D-Cys
SXCEVCCNPACTGCY

SEQ ID NO: 1303 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
SXCEVCCNPACTGX

SEQ ID NO: 1304 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
SXCEVCCNPACTGXK

SEQ ID NO: 1305 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
SXCEVCCNPACTGXY

SEQ ID NO: 1306 - protein, 14 aa, Artificial Sequence
  Synthetically generated peptide
  misc_feature (2)..(2): Xaa can be Cys or D-Cys
SXCEVCCTPACTGC

SEQ ID NO: 1307 - protein, 15 aa, Artificial Sequence
  Synthetically generated peptide
  misc_feature (2)..(2): Xaa can be Cys or D-Cys
SXCEVCCTPACTGCK

SEQ ID NO: 1308 - protein, 15 aa, Artificial Sequence
  Synthetically generated peptide
  misc_feature (2)..(2): Xaa can be Cys or D-Cys
SXCEVCCTPACTGCY

SEQ ID NO: 1309 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
SXCEVCCTPACTGX

SEQ ID NO: 1310 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
SXCEVCCTPACTGXK

SEQ ID NO: 1311 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
SXCEVCCTPACTGXY

SEQ ID NO: 1312 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
SXCEVXCNPACTGC

SEQ ID NO: 1313 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
SXCEVXCNPACTGCK

SEQ ID NO: 1314 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
SXCEVXCNPACTGCY

SEQ ID NO: 1315 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCEVXCNPACTGX

SEQ ID NO: 1316 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCEVXCNPACTGXK

SEQ ID NO: 1317 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCEVXCNPACTGXY

SEQ ID NO: 1318 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
SXCEVXCTPACTGC

SEQ ID NO: 1319 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
SXCEVXCTPACTGCK

SEQ ID NO: 1320 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
SXCEVXCTPACTGCY

SEQ ID NO: 1321 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCEVXCTPACTGX

SEQ ID NO: 1322 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCEVXCTPACTGXK

SEQ ID NO: 1323 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCEVXCTPACTGXY

SEQ ID NO: 1324 - protein, 14 aa, Artificial Sequence
  Synthetically generated peptide
  misc_feature (2)..(2): Xaa can be Cys or D-Cys
SXCEICCNPACTGC

SEQ ID NO: 1325 - protein, 15 aa, Artificial Sequence
  Synthetically generated peptide
  misc_feature (2)..(2): Xaa can be Cys or D-Cys
SXCEICCNPACTGCK

SEQ ID NO: 1326 - protein, 15 aa, Artificial Sequence
  Synthetically generated peptide
  misc_feature (2)..(2): Xaa can be Cys or D-Cys
SXCEICCNPACTGCY

SEQ ID NO: 1327 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
SXCEICCNPACTGX

SEQ ID NO: 1328 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
SXCEICCNPACTGXK

SEQ ID NO: 1329 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
SXCEICCNPACTGXY

SEQ ID NO: 1330 - protein, 14 aa, Artificial Sequence
  Synthetically generated peptide
  misc_feature (2)..(2): Xaa can be Cys or D-Cys
SXCEICCTPACTGC

SEQ ID NO: 1331 - protein, 15 aa, Artificial Sequence
  Synthetically generated peptide
  misc_feature (2)..(2): Xaa can be Cys or D-Cys
SXCEICCTPACTGCK

SEQ ID NO: 1332 - protein, 15 aa, Artificial Sequence
  Synthetically generated peptide
  misc_feature (2)..(2): Xaa can be Cys or D-Cys
SXCEICCTPACTGCY

SEQ ID NO: 1333 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
SXCEICCTPACTGX

SEQ ID NO: 1334 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
SXCEICCTPACTGXK

SEQ ID NO: 1335 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
SXCEICCTPACTGXY

SEQ ID NO: 1336 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
SXCEIXCNPACTGC

SEQ ID NO: 1337 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
SXCEIXCNPACTGCK

SEQ ID NO: 1338 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
SXCEIXCNPACTGCY

SEQ ID NO: 1339 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCEIXCNPACTGX

SEQ ID NO: 1340 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCEIXCNPACTGXK

SEQ ID NO: 1341 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCEIXCNPACTGXY

SEQ ID NO: 1342 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
SXCEIXCTPACTGC

SEQ ID NO: 1343 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
SXCEIXCTPACTGCK

SEQ ID NO: 1344 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
SXCEIXCTPACTGCY

SEQ ID NO: 1345 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCEIXCTPACTGX

SEQ ID NO: 1346 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCEIXCTPACTGXK

SEQ ID NO: 1347 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCEIXCTPACTGXY

SEQ ID NO: 1348 - protein, 14 aa, Artificial Sequence
  Synthetically generated peptide
  misc_feature (2)..(2): Xaa can be Cys or D-Cys
SXCELCCNPACTGC

SEQ ID NO: 1349 - protein, 15 aa, Artificial Sequence
  Synthetically generated peptide
  misc_feature (2)..(2): Xaa can be Cys or D-Cys
SXCELCCNPACTGCK

SEQ ID NO: 1350 - protein, 15 aa, Artificial Sequence
  Synthetically generated peptide
  misc_feature (2)..(2): Xaa can be Cys or D-Cys
SXCELCCNPACTGCY

SEQ ID NO: 1351 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
SXCELCCNPACTGX

SEQ ID NO: 1352 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
SXCELCCNPACTGXK

SEQ ID NO: 1353 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
SXCELCCNPACTGXY

SEQ ID NO: 1354 - protein, 14 aa, Artificial Sequence
  Synthetically generated peptide
  misc_feature (2)..(2): Xaa can be Cys or D-Cys
SXCELCCTPACTGC

SEQ ID NO: 1355 - protein, 15 aa, Artificial Sequence
  Synthetically generated peptide
  misc_feature (2)..(2): Xaa can be Cys or D-Cys
SXCELCCTPACTGCK

SEQ ID NO: 1356 - protein, 15 aa, Artificial Sequence
  Synthetically generated peptide
  misc_feature (2)..(2): Xaa can be Cys or D-Cys
SXCELCCTPACTGCY

SEQ ID NO: 1357 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
SXCELCCTPACTGX

SEQ ID NO: 1358 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
SXCELCCTPACTGXK

SEQ ID NO: 1359 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
SXCELCCTPACTGXY

SEQ ID NO: 1360 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
SXCELXCNPACTGC

SEQ ID NO: 1361 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
SXCELXCNPACTGCK

SEQ ID NO: 1362 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
SXCELXCNPACTGCY

SEQ ID NO: 1363 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCELXCNPACTGX

SEQ ID NO: 1364 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCELXCNPACTGXK

SEQ ID NO: 1365 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCELXCNPACTGXY

SEQ ID NO: 1366 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
SXCELXCTPACTGC

SEQ ID NO: 1367 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
SXCELXCTPACTGCK

SEQ ID NO: 1368 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
SXCELXCTPACTGCY

SEQ ID NO: 1369 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCELXCTPACTGX

SEQ ID NO: 1370 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCELXCTPACTGXK

SEQ ID NO: 1371 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCELXCTPACTGXY

SEQ ID NO: 1372 - protein, 14 aa, Artificial Sequence
  Synthetically generated peptide
  misc_feature (2)..(2): Xaa can be Cys or D-Cys
SXCEYCCNPACTGC

SEQ ID NO: 1373 - protein, 15 aa, Artificial Sequence
  Synthetically generated peptide
  misc_feature (2)..(2): Xaa can be Cys or D-Cys
SXCEYCCNPACTGCK

SEQ ID NO: 1374 - protein, 15 aa, Artificial Sequence
  Synthetically generated peptide
  misc_feature (2)..(2): Xaa can be Cys or D-Cys
SXCEYCCNPACTGCY

SEQ ID NO: 1375 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
SXCEYCCNPACTGX

SEQ ID NO: 1376 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
SXCEYCCNPACTGXK

SEQ ID NO: 1377 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
SXCEYCCNPACTGXY

SEQ ID NO: 1378 - protein, 14 aa, Artificial Sequence
  Synthetically generated peptide
  misc_feature (2)..(2): Xaa can be Cys or D-Cys
SXCEYCCTPACTGC

SEQ ID NO: 1379 - protein, 15 aa, Artificial Sequence
  Synthetically generated peptide
  misc_feature (2)..(2): Xaa can be Cys or D-Cys
SXCEYCCTPACTGCK

SEQ ID NO: 1380 - protein, 15 aa, Artificial Sequence
  Synthetically generated peptide
  misc_feature (2)..(2): Xaa can be Cys or D-Cys
SXCEYCCTPACTGCY

SEQ ID NO: 1381 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
SXCEYCCTPACTGX

SEQ ID NO: 1382 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
SXCEYCCTPACTGXK

SEQ ID NO: 1383 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
SXCEYCCTPACTGXY

SEQ ID NO: 1384 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
SXCEYXCNPACTGC

SEQ ID NO: 1385 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
SXCEYXCNPACTGCK

SEQ ID NO: 1386 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
SXCEYXCNPACTGCY

SEQ ID NO: 1387 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCEYXCNPACTGX

SEQ ID NO: 1388 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCEYXCNPACTGXK

SEQ ID NO: 1389 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCEYXCNPACTGXY

SEQ ID NO: 1390 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
SXCEYXCTPACTGC

SEQ ID NO: 1391 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
SXCEYXCTPACTGCK

SEQ ID NO: 1392 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
SXCEYXCTPACTGCY

SEQ ID NO: 1393 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCEYXCTPACTGX

SEQ ID NO: 1394 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCEYXCTPACTGXK

SEQ ID NO: 1395 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCEYXCTPACTGXY

SEQ ID NO: 1396 - protein, 14 aa, Artificial Sequence
  Synthetically generated peptide
  misc_feature (2)..(2): Xaa can be Cys or D-Cys
SXCEFCCNPACTGC

SEQ ID NO: 1397 - protein, 15 aa, Artificial Sequence
  Synthetically generated peptide
  misc_feature (2)..(2): Xaa can be Cys or D-Cys
SXCEFCCNPACTGCK

SEQ ID NO: 1398 - protein, 15 aa, Artificial Sequence
  Synthetically generated peptide
  misc_feature (2)..(2): Xaa can be Cys or D-Cys
SXCEFCCNPACTGCY

SEQ ID NO: 1399 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
SXCEFCCNPACTGX

SEQ ID NO: 1400 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
SXCEFCCNPACTGXK

SEQ ID NO: 1401 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
SXCEFCCNPACTGXY

SEQ ID NO: 1402 - protein, 14 aa, Artificial Sequence
  Synthetically generated peptide
  misc_feature (2)..(2): Xaa can be Cys or D-Cys
SXCEFCCTPACTGC

SEQ ID NO: 1403 - protein, 15 aa, Artificial Sequence
  Synthetically generated peptide
  misc_feature (2)..(2): Xaa can be Cys or D-Cys
SXCEFCCTPACTGCK

SEQ ID NO: 1404 - protein, 15 aa, Artificial Sequence
  Synthetically generated peptide
  misc_feature (2)..(2): Xaa can be Cys or D-Cys
SXCEFCCTPACTGCY

SEQ ID NO: 1405 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
SXCEFCCTPACTGX

SEQ ID NO: 1406 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
SXCEFCCTPACTGXK

SEQ ID NO: 1407 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
SXCEFCCTPACTGXY

SEQ ID NO: 1408 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
SXCEFXCNPACTGC

SEQ ID NO: 1409 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
SXCEFXCNPACTGCK

SEQ ID NO: 1410 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
SXCEFXCNPACTGCY

SEQ ID NO: 1411 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCEFXCNPACTGX

SEQ ID NO: 1412 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCEFXCNPACTGXK

SEQ ID NO: 1413 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCEFXCNPACTGXY

SEQ ID NO: 1414 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
SXCEFXCTPACTGC

SEQ ID NO: 1415 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
SXCEFXCTPACTGCK

SEQ ID NO: 1416 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
SXCEFXCTPACTGCY

SEQ ID NO: 1417 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCEFXCTPACTGX

SEQ ID NO: 1418 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCEFXCTPACTGXK

SEQ ID NO: 1419 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCEFXCTPACTGXY

SEQ ID NO: 1420 - protein, 14 aa, Artificial Sequence
  Synthetically generated peptide
  misc_feature (2)..(2): Xaa can be Cys or D-Cys
SXCEWCCNPACTGC

SEQ ID NO: 1421 - protein, 15 aa, Artificial Sequence
  Synthetically generated peptide
  misc_feature (2)..(2): Xaa can be Cys or D-Cys
SXCEWCCNPACTGCK

SEQ ID NO: 1422 - protein, 15 aa, Artificial Sequence
  Synthetically generated peptide
  misc_feature (2)..(2): Xaa can be Cys or D-Cys
SXCEWCCNPACTGCY

SEQ ID NO: 1423 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
SXCEWCCNPACTGX

SEQ ID NO: 1424 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
SXCEWCCNPACTGXK

SEQ ID NO: 1425 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
SXCEWCCNPACTGXY

SEQ ID NO: 1426 - protein, 14 aa, Artificial Sequence
  Synthetically generated peptide
  misc_feature (2)..(2): Xaa can be Cys or D-Cys
SXCEWCCTPACTGC

SEQ ID NO: 1427 - protein, 15 aa, Artificial Sequence
  Synthetically generated peptide
  misc_feature (2)..(2): Xaa can be Cys or D-Cys
SXCEWCCTPACTGCK

SEQ ID NO: 1428 - protein, 15 aa, Artificial Sequence
  Synthetically generated peptide
  misc_feature (2)..(2): Xaa can be Cys or D-Cys
SXCEWCCTPACTGCY

SEQ ID NO: 1429 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
SXCEWCCTPACTGX

SEQ ID NO: 1430 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
SXCEWCCTPACTGXK

SEQ ID NO: 1431 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
SXCEWCCTPACTGXY

SEQ ID NO: 1432 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
SXCEWXCNPACTGC

SEQ ID NO: 1433 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
SXCEWXCNPACTGCK

SEQ ID NO: 1434 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
SXCEWXCNPACTGCY

SEQ ID NO: 1435 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCEWXCNPACTGX

SEQ ID NO: 1436 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCEWXCNPACTGXK

SEQ ID NO: 1437 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCEWXCNPACTGXY

SEQ ID NO: 1438 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
SXCEWXCTPACTGC

SEQ ID NO: 1439 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
SXCEWXCTPACTGCK

SEQ ID NO: 1440 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
SXCEWXCTPACTGCY

SEQ ID NO: 1441 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCEWXCTPACTGX

SEQ ID NO: 1442 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCEWXCTPACTGXK

SEQ ID NO: 1443 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
SXCEWXCTPACTGXY

SEQ ID NO: 1444 - protein, 14 aa, Artificial Sequence
  Synthetically generated peptide
VCCEVCCNPACTGC

SEQ ID NO: 1445 - protein, 15 aa, Artificial Sequence
  Synthetically generated peptide
VCCEVCCNPACTGCK

SEQ ID NO: 1446 - protein, 15 aa, Artificial Sequence
  Synthetically generated peptide
VCCEVCCNPACTGCY

SEQ ID NO: 1447 - protein, 14 aa, Artificial Sequence
  Synthetically generated peptide
  misc_feature (14)..(14): Xaa can be Cys or D-Cys
VCCEVCCNPACTGX

SEQ ID NO: 1448 - protein, 15 aa, Artificial Sequence
  Synthetically generated peptide
  misc_feature (14)..(14): Xaa can be Cys or D-Cys
VCCEVCCNPACTGXK

SEQ ID NO: 1449 - protein, 15 aa, Artificial Sequence
  Synthetically generated peptide
  misc_feature (14)..(14): Xaa can be Cys or D-Cys
VCCEVCCNPACTGXY

SEQ ID NO: 1450 - protein, 14 aa, Artificial Sequence
  Synthetically generated peptide
VCCEVCCTPACTGC

SEQ ID NO: 1451 - protein, 15 aa, Artificial Sequence
  Synthetically generated peptide
VCCEVCCTPACTGCK

SEQ ID NO: 1452 - protein, 15 aa, Artificial Sequence
  Synthetically generated peptide
VCCEVCCTPACTGCY

SEQ ID NO: 1453 - protein, 14 aa, Artificial Sequence
  Synthetically generated peptide
  misc_feature (14)..(14): Xaa can be Cys or D-Cys
VCCEVCCTPACTGX

SEQ ID NO: 1454 - protein, 15 aa, Artificial Sequence
  Synthetically generated peptide
  misc_feature (14)..(14): Xaa can be Cys or D-Cys
VCCEVCCTPACTGXK

SEQ ID NO: 1455 - protein, 15 aa, Artificial Sequence
  Synthetically generated peptide
  misc_feature (14)..(14): Xaa can be Cys or D-Cys
VCCEVCCTPACTGXY

SEQ ID NO: 1456 - protein, 14 aa, Artificial Sequence
  Synthetically generated peptide
  misc_feature (6)..(6): Xaa can be Cys or D-Cys
VCCEVXCNPACTGC

SEQ ID NO: 1457 - protein, 15 aa, Artificial Sequence
  Synthetically generated peptide
  misc_feature (6)..(6): Xaa can be Cys or D-Cys
VCCEVXCNPACTGCK

SEQ ID NO: 1458 - protein, 15 aa, Artificial Sequence
  Synthetically generated peptide
  misc_feature (6)..(6): Xaa can be Cys or D-Cys
VCCEVXCNPACTGCY

SEQ ID NO: 1459 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
VCCEVXCNPACTGX

SEQ ID NO: 1460 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
VCCEVXCNPACTGXK

SEQ ID NO: 1461 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
VCCEVXCNPACTGXY

SEQ ID NO: 1462 - protein, 14 aa, Artificial Sequence
  Synthetically generated peptide
  misc_feature (6)..(6): Xaa can be Cys or D-Cys
VCCEVXCTPACTGC

SEQ ID NO: 1463 - protein, 15 aa, Artificial Sequence
  Synthetically generated peptide
  misc_feature (6)..(6): Xaa can be Cys or D-Cys
VCCEVXCTPACTGCK

SEQ ID NO: 1464 - protein, 15 aa, Artificial Sequence
  Synthetically generated peptide
  misc_feature (6)..(6): Xaa can be Cys or D-Cys
VCCEVXCTPACTGCY

SEQ ID NO: 1465 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
VCCEVXCTPACTGX

SEQ ID NO: 1466 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
VCCEVXCTPACTGXK

SEQ ID NO: 1467 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
VCCEVXCTPACTGXY

SEQ ID NO: 1468 - protein, 14 aa, Artificial Sequence
  Synthetically generated peptide
VCCEICCNPACTGC

SEQ ID NO: 1469 - protein, 15 aa, Artificial Sequence
  Synthetically generated peptide
VCCEICCNPACTGCK

SEQ ID NO: 1470 - protein, 15 aa, Artificial Sequence
  Synthetically generated peptide
VCCEICCNPACTGCY

SEQ ID NO: 1471 - protein, 14 aa, Artificial Sequence
  Synthetically generated peptide
  misc_feature (14)..(14): Xaa can be Cys or D-Cys
VCCEICCNPACTGX

SEQ ID NO: 1472 - protein, 15 aa, Artificial Sequence
  Synthetically generated peptide
  misc_feature (14)..(14): Xaa can be Cys or D-Cys
VCCEICCNPACTGXK

SEQ ID NO: 1473 - protein, 15 aa, Artificial Sequence
  Synthetically generated peptide
  misc_feature (14)..(14): Xaa can be Cys or D-Cys
VCCEICCNPACTGXY

SEQ ID NO: 1474 - protein, 14 aa, Artificial Sequence
  Synthetically generated peptide
VCCEICCTPACTGC

SEQ ID NO: 1475 - protein, 15 aa, Artificial Sequence
  Synthetically generated peptide
VCCEICCTPACTGCK

SEQ ID NO: 1476 - protein, 15 aa, Artificial Sequence
  Synthetically generated peptide
VCCEICCTPACTGCY

SEQ ID NO: 1477 - protein, 14 aa, Artificial Sequence
  Synthetically generated peptide
  misc_feature (14)..(14): Xaa can be Cys or D-Cys
VCCEICCTPACTGX

SEQ ID NO: 1478 - protein, 15 aa, Artificial Sequence
  Synthetically generated peptide
  misc_feature (14)..(14): Xaa can be Cys or D-Cys
VCCEICCTPACTGXK

SEQ ID NO: 1479 - protein, 15 aa, Artificial Sequence
  Synthetically generated peptide
  misc_feature (14)..(14): Xaa can be Cys or D-Cys
VCCEICCTPACTGXY

SEQ ID NO: 1480 - protein, 14 aa, Artificial Sequence
  Synthetically generated peptide
  misc_feature (6)..(6): Xaa can be Cys or D-Cys
VCCEIXCNPACTGC

SEQ ID NO: 1481 - protein, 15 aa, Artificial Sequence
  Synthetically generated peptide
  misc_feature (6)..(6): Xaa can be Cys or D-Cys
VCCEIXCNPACTGCK

SEQ ID NO: 1482 - protein, 15 aa, Artificial Sequence
  Synthetically generated peptide
  misc_feature (6)..(6): Xaa can be Cys or D-Cys
VCCEIXCNPACTGCY

SEQ ID NO: 1483 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
VCCEIXCNPACTGX

SEQ ID NO: 1484 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
VCCEIXCNPACTGXK

SEQ ID NO: 1485 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
VCCEIXCNPACTGXY

SEQ ID NO: 1486 - protein, 14 aa, Artificial Sequence
  Synthetically generated peptide
  misc_feature (6)..(6): Xaa can be Cys or D-Cys
VCCEIXCTPACTGC

SEQ ID NO: 1487 - protein, 15 aa, Artificial Sequence
  Synthetically generated peptide
  misc_feature (6)..(6): Xaa can be Cys or D-Cys
VCCEIXCTPACTGCK

SEQ ID NO: 1488 - protein, 15 aa, Artificial Sequence
  Synthetically generated peptide
  misc_feature (6)..(6): Xaa can be Cys or D-Cys
VCCEIXCTPACTGCY

SEQ ID NO: 1489 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
VCCEIXCTPACTGX

SEQ ID NO: 1490 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
VCCEIXCTPACTGXK

SEQ ID NO: 1491 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
VCCEIXCTPACTGXY

SEQ ID NO: 1492 - protein, 14 aa, Artificial Sequence
  Synthetically generated peptide
VCCELCCNPACTGC

SEQ ID NO: 1493 - protein, 15 aa, Artificial Sequence
  Synthetically generated peptide
VCCELCCNPACTGCK

SEQ ID NO: 1494 - protein, 15 aa, Artificial Sequence
  Synthetically generated peptide
VCCELCCNPACTGCY

SEQ ID NO: 1495 - protein, 14 aa, Artificial Sequence
  Synthetically generated peptide
  misc_feature (14)..(14): Xaa can be Cys or D-Cys
VCCELCCNPACTGX

SEQ ID NO: 1496 - protein, 15 aa, Artificial Sequence
  Synthetically generated peptide
  misc_feature (14)..(14): Xaa can be Cys or D-Cys
VCCELCCNPACTGXK

SEQ ID NO: 1497 - protein, 15 aa, Artificial Sequence
  Synthetically generated peptide
  misc_feature (14)..(14): Xaa can be Cys or D-Cys
VCCELCCNPACTGXY

SEQ ID NO: 1498 - protein, 14 aa, Artificial Sequence
  Synthetically generated peptide
VCCELCCTPACTGC

SEQ ID NO: 1499 - protein, 15 aa, Artificial Sequence
  Synthetically generated peptide
VCCELCCTPACTGCK

SEQ ID NO: 1500 - protein, 15 aa, Artificial Sequence
  Synthetically generated peptide
VCCELCCTPACTGCY

SEQ ID NO: 1501 - protein, 14 aa, Artificial Sequence
  Synthetically generated peptide
  misc_feature (14)..(14): Xaa can be Cys or D-Cys
VCCELCCTPACTGX

SEQ ID NO: 1502 - protein, 15 aa, Artificial Sequence
  Synthetically generated peptide
  misc_feature (14)..(14): Xaa can be Cys or D-Cys
VCCELCCTPACTGXK

SEQ ID NO: 1503 - protein, 15 aa, Artificial Sequence
  Synthetically generated peptide
  misc_feature (14)..(14): Xaa can be Cys or D-Cys
VCCELCCTPACTGXY

SEQ ID NO: 1504 - protein, 14 aa, Artificial Sequence
  Synthetically generated peptide
  misc_feature (6)..(6): Xaa can be Cys or D-Cys
VCCELXCNPACTGC

SEQ ID NO: 1505 - protein, 15 aa, Artificial Sequence
  Synthetically generated peptide
  misc_feature (6)..(6): Xaa can be Cys or D-Cys
VCCELXCNPACTGCK

SEQ ID NO: 1506 - protein, 15 aa, Artificial Sequence
  Synthetically generated peptide
  misc_feature (6)..(6): Xaa can be Cys or D-Cys
VCCELXCNPACTGCY

SEQ ID NO: 1507 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
VCCELXCNPACTGX

SEQ ID NO: 1508 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
VCCELXCNPACTGXK

SEQ ID NO: 1509 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
VCCELXCNPACTGXY

SEQ ID NO: 1510 - protein, 14 aa, Artificial Sequence
  Synthetically generated peptide
  misc_feature (6)..(6): Xaa can be Cys or D-Cys
VCCELXCTPACTGC

SEQ ID NO: 1511 - protein, 15 aa, Artificial Sequence
  Synthetically generated peptide
  misc_feature (6)..(6): Xaa can be Cys or D-Cys
VCCELXCTPACTGCK

SEQ ID NO: 1512 - protein, 15 aa, Artificial Sequence
  Synthetically generated peptide
  misc_feature (6)..(6): Xaa can be Cys or D-Cys
VCCELXCTPACTGCY

SEQ ID NO: 1513 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
VCCELXCTPACTGX

SEQ ID NO: 1514 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
VCCELXCTPACTGXK

SEQ ID NO: 1515 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
VCCELXCTPACTGXY

SEQ ID NO: 1516 - protein, 14 aa, Artificial Sequence
  Synthetically generated peptide
VCCEYCCNPACTGC

SEQ ID NO: 1517 - protein, 15 aa, Artificial Sequence
  Synthetically generated peptide
VCCEYCCNPACTGCK

SEQ ID NO: 1518 - protein, 15 aa, Artificial Sequence
  Synthetically generated peptide
VCCEYCCNPACTGCY

SEQ ID NO: 1519 - protein, 14 aa, Artificial Sequence
  Synthetically generated peptide
  misc_feature (14)..(14): Xaa can be Cys or D-Cys
VCCEYCCNPACTGX

SEQ ID NO: 1520 - protein, 15 aa, Artificial Sequence
  Synthetically generated peptide
  misc_feature (14)..(14): Xaa can be Cys or D-Cys
VCCEYCCNPACTGXK

SEQ ID NO: 1521 - protein, 15 aa, Artificial Sequence
  Synthetically generated peptide
  misc_feature (14)..(14): Xaa can be Cys or D-Cys
VCCEYCCNPACTGXY

SEQ ID NO: 1522 - protein, 14 aa, Artificial Sequence
  Synthetically generated peptide
VCCEYCCTPACTGC

SEQ ID NO: 1523 - protein, 15 aa, Artificial Sequence
  Synthetically generated peptide
VCCEYCCTPACTGCK

SEQ ID NO: 1524 - protein, 15 aa, Artificial Sequence
  Synthetically generated peptide
VCCEYCCTPACTGCY

SEQ ID NO: 1525 - protein, 14 aa, Artificial Sequence
  Synthetically generated peptide
  misc_feature (14)..(14): Xaa can be Cys or D-Cys
VCCEYCCTPACTGX

SEQ ID NO: 1526 - protein, 15 aa, Artificial Sequence
  Synthetically generated peptide
  misc_feature (14)..(14): Xaa can be Cys or D-Cys
VCCEYCCTPACTGXK

SEQ ID NO: 1527 - protein, 15 aa, Artificial Sequence
  Synthetically generated peptide
  misc_feature (14)..(14): Xaa can be Cys or D-Cys
VCCEYCCTPACTGXY

SEQ ID NO: 1528 - protein, 14 aa, Artificial Sequence
  Synthetically generated peptide
  misc_feature (6)..(6): Xaa can be Cys or D-Cys
VCCEYXCNPACTGC

SEQ ID NO: 1529 - protein, 15 aa, Artificial Sequence
  Synthetically generated peptide
  misc_feature (6)..(6): Xaa can be Cys or D-Cys
VCCEYXCNPACTGCK

SEQ ID NO: 1530 - protein, 15 aa, Artificial Sequence
  Synthetically generated peptide
  misc_feature (6)..(6): Xaa can be Cys or D-Cys
VCCEYXCNPACTGCY

SEQ ID NO: 1531 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
VCCEYXCNPACTGX

SEQ ID NO: 1532 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
VCCEYXCNPACTGXK

SEQ ID NO: 1533 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
VCCEYXCNPACTGXY

SEQ ID NO: 1534 - protein, 14 aa, Artificial Sequence
  Synthetically generated peptide
  misc_feature (6)..(6): Xaa can be Cys or D-Cys
VCCEYXCTPACTGC

SEQ ID NO: 1535 - protein, 15 aa, Artificial Sequence
  Synthetically generated peptide
  misc_feature (6)..(6): Xaa can be Cys or D-Cys
VCCEYXCTPACTGCK

SEQ ID NO: 1536 - protein, 15 aa, Artificial Sequence
  Synthetically generated peptide
  misc_feature (6)..(6): Xaa can be Cys or D-Cys
VCCEYXCTPACTGCY

SEQ ID NO: 1537 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
VCCEYXCTPACTGX

SEQ ID NO: 1538 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
VCCEYXCTPACTGXK

SEQ ID NO: 1539 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
VCCEYXCTPACTGXY

SEQ ID NO: 1540 - protein, 14 aa, Artificial Sequence
  Synthetically generated peptide
VCCEFCCNPACTGC

SEQ ID NO: 1541 - protein, 15 aa, Artificial Sequence
  Synthetically generated peptide
VCCEFCCNPACTGCK

SEQ ID NO: 1542 - protein, 15 aa, Artificial Sequence
  Synthetically generated peptide
VCCEFCCNPACTGCY

SEQ ID NO: 1543 - protein, 14 aa, Artificial Sequence
  Synthetically generated peptide
  misc_feature (14)..(14): Xaa can be Cys or D-Cys
VCCEFCCNPACTGX

SEQ ID NO: 1544 - protein, 15 aa, Artificial Sequence
  Synthetically generated peptide
  misc_feature (14)..(14): Xaa can be Cys or D-Cys
VCCEFCCNPACTGXK

SEQ ID NO: 1545 - protein, 15 aa, Artificial Sequence
  Synthetically generated peptide
  misc_feature (14)..(14): Xaa can be Cys or D-Cys
VCCEFCCNPACTGXY

SEQ ID NO: 1546 - protein, 14 aa, Artificial Sequence
  Synthetically generated peptide
VCCEFCCTPACTGC

SEQ ID NO: 1547 - protein, 15 aa, Artificial Sequence
  Synthetically generated peptide
VCCEFCCTPACTGCK

SEQ ID NO: 1548 - protein, 15 aa, Artificial Sequence
  Synthetically generated peptide
VCCEFCCTPACTGCY

SEQ ID NO: 1549 - protein, 14 aa, Artificial Sequence
  Synthetically generated peptide
  misc_feature (14)..(14): Xaa can be Cys or D-Cys
VCCEFCCTPACTGX

SEQ ID NO: 1550 - protein, 15 aa, Artificial Sequence
  Synthetically generated peptide
  misc_feature (14)..(14): Xaa can be Cys or D-Cys
VCCEFCCTPACTGXK

SEQ ID NO: 1551 - protein, 15 aa, Artificial Sequence
  Synthetically generated peptide
  misc_feature (14)..(14): Xaa can be Cys or D-Cys
VCCEFCCTPACTGXY

SEQ ID NO: 1552 - protein, 14 aa, Artificial Sequence
  Synthetically generated peptide
  misc_feature (6)..(6): Xaa can be Cys or D-Cys
VCCEFXCNPACTGC

SEQ ID NO: 1553 - protein, 15 aa, Artificial Sequence
  Synthetically generated peptide
  misc_feature (6)..(6): Xaa can be Cys or D-Cys
VCCEFXCNPACTGCK

SEQ ID NO: 1554 - protein, 15 aa, Artificial Sequence
  Synthetically generated peptide
  misc_feature (6)..(6): Xaa can be Cys or D-Cys
VCCEFXCNPACTGCY

SEQ ID NO: 1555 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
VCCEFXCNPACTGX

SEQ ID NO: 1556 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
VCCEFXCNPACTGXK

SEQ ID NO: 1557 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
VCCEFXCNPACTGXY

SEQ ID NO: 1558 - protein, 14 aa, Artificial Sequence
  Synthetically generated peptide
  misc_feature (6)..(6): Xaa can be Cys or D-Cys
VCCEFXCTPACTGC

SEQ ID NO: 1559 - protein, 15 aa, Artificial Sequence
  Synthetically generated peptide
  misc_feature (6)..(6): Xaa can be Cys or D-Cys
VCCEFXCTPACTGCK

SEQ ID NO: 1560 - protein, 15 aa, Artificial Sequence
  Synthetically generated peptide
  misc_feature (6)..(6): Xaa can be Cys or D-Cys
VCCEFXCTPACTGCY

SEQ ID NO: 1561 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
VCCEFXCTPACTGX

SEQ ID NO: 1562 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
VCCEFXCTPACTGXK

SEQ ID NO: 1563 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
VCCEFXCTPACTGXY

SEQ ID NO: 1564 - protein, 14 aa, Artificial Sequence
  Synthetically generated peptide
VCCEWCCNPACTGC

SEQ ID NO: 1565 - protein, 15 aa, Artificial Sequence
  Synthetically generated peptide
VCCEWCCNPACTGCK

SEQ ID NO: 1566 - protein, 15 aa, Artificial Sequence
  Synthetically generated peptide
VCCEWCCNPACTGCY

SEQ ID NO: 1567 - protein, 14 aa, Artificial Sequence
  Synthetically generated peptide
  misc_feature (14)..(14): Xaa can be Cys or D-Cys
VCCEWCCNPACTGX

SEQ ID NO: 1568 - protein, 15 aa, Artificial Sequence
  Synthetically generated peptide
  misc_feature (14)..(14): Xaa can be Cys or D-Cys
VCCEWCCNPACTGXK

SEQ ID NO: 1569 - protein, 15 aa, Artificial Sequence
  Synthetically generated peptide
  misc_feature (14)..(14): Xaa can be Cys or D-Cys
VCCEWCCNPACTGXY

SEQ ID NO: 1570 - protein, 14 aa, Artificial Sequence
  Synthetically generated peptide
VCCEWCCTPACTGC

SEQ ID NO: 1571 - protein, 15 aa, Artificial Sequence
  Synthetically generated peptide
VCCEWCCTPACTGCK

SEQ ID NO: 1572 - protein, 15 aa, Artificial Sequence
  Synthetically generated peptide
VCCEWCCTPACTGCY

SEQ ID NO: 1573 - protein, 14 aa, Artificial Sequence
  Synthetically generated peptide
  misc_feature (14)..(14): Xaa can be Cys or D-Cys
VCCEWCCTPACTGX

SEQ ID NO: 1574 - protein, 15 aa, Artificial Sequence
  Synthetically generated peptide
  misc_feature (14)..(14): Xaa can be Cys or D-Cys
VCCEWCCTPACTGXK

SEQ ID NO: 1575 - protein, 15 aa, Artificial Sequence
  Synthetically generated peptide
  misc_feature (14)..(14): Xaa can be Cys or D-Cys
VCCEWCCTPACTGXY

SEQ ID NO: 1576 - protein, 14 aa, Artificial Sequence
  Synthetically generated peptide
  misc_feature (6)..(6): Xaa can be Cys or D-Cys
VCCEWXCNPACTGC

SEQ ID NO: 1577 - protein, 15 aa, Artificial Sequence
  Synthetically generated peptide
  misc_feature (6)..(6): Xaa can be Cys or D-Cys
VCCEWXCNPACTGCK

SEQ ID NO: 1578 - protein, 15 aa, Artificial Sequence
  Synthetically generated peptide
  misc_feature (6)..(6): Xaa can be Cys or D-Cys
VCCEWXCNPACTGCY

SEQ ID NO: 1579 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
VCCEWXCNPACTGX

SEQ ID NO: 1580 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
VCCEWXCNPACTGXK

SEQ ID NO: 1581 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
VCCEWXCNPACTGXY

SEQ ID NO: 1582 - protein, 14 aa, Artificial Sequence
  Synthetically generated peptide
  misc_feature (6)..(6): Xaa can be Cys or D-Cys
VCCEWXCTPACTGC

SEQ ID NO: 1583 - protein, 15 aa, Artificial Sequence
  Synthetically generated peptide
  misc_feature (6)..(6): Xaa can be Cys or D-Cys
VCCEWXCTPACTGCK

SEQ ID NO: 1584 - protein, 15 aa, Artificial Sequence
  Synthetically generated peptide
  misc_feature (6)..(6): Xaa can be Cys or D-Cys
VCCEWXCTPACTGCY

SEQ ID NO: 1585 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
VCCEWXCTPACTGX

SEQ ID NO: 1586 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
VCCEWXCTPACTGXK

SEQ ID NO: 1587 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
VCCEWXCTPACTGXY

SEQ ID NO: 1588 - protein, 14 aa, Artificial Sequence
  Synthetically generated peptide
  misc_feature (2)..(2): Xaa can be Cys or D-Cys
VXCEVCCNPACTGC

SEQ ID NO: 1589 - protein, 15 aa, Artificial Sequence
  Synthetically generated peptide
  misc_feature (2)..(2): Xaa can be Cys or D-Cys
VXCEVCCNPACTGCK

SEQ ID NO: 1590 - protein, 15 aa, Artificial Sequence
  Synthetically generated peptide
  misc_feature (2)..(2): Xaa can be Cys or D-Cys
VXCEVCCNPACTGCY

SEQ ID NO: 1591 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
VXCEVCCNPACTGX

SEQ ID NO: 1592 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
VXCEVCCNPACTGXK

SEQ ID NO: 1593 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
VXCEVCCNPACTGXY

SEQ ID NO: 1594 - protein, 14 aa, Artificial Sequence
  Synthetically generated peptide
  misc_feature (2)..(2): Xaa can be Cys or D-Cys
VXCEVCCTPACTGC

SEQ ID NO: 1595 - protein, 15 aa, Artificial Sequence
  Synthetically generated peptide
  misc_feature (2)..(2): Xaa can be Cys or D-Cys
VXCEVCCTPACTGCK

SEQ ID NO: 1596 - protein, 15 aa, Artificial Sequence
  Synthetically generated peptide
  misc_feature (2)..(2): Xaa can be Cys or D-Cys
VXCEVCCTPACTGCY

SEQ ID NO: 1597 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
VXCEVCCTPACTGX

SEQ ID NO: 1598 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
VXCEVCCTPACTGXK

SEQ ID NO: 1599 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
VXCEVCCTPACTGXY

SEQ ID NO: 1600 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
VXCEVXCNPACTGC

SEQ ID NO: 1601 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
VXCEVXCNPACTGCK

SEQ ID NO: 1602 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
VXCEVXCNPACTGCY

SEQ ID NO: 1603 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCEVXCNPACTGX

SEQ ID NO: 1604 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCEVXCNPACTGXK

SEQ ID NO: 1605 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCEVXCNPACTGXY

SEQ ID NO: 1606 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
VXCEVXCTPACTGC

SEQ ID NO: 1607 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
VXCEVXCTPACTGCK

SEQ ID NO: 1608 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
VXCEVXCTPACTGCY

SEQ ID NO: 1609 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCEVXCTPACTGX

SEQ ID NO: 1610 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCEVXCTPACTGXK

SEQ ID NO: 1611 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCEVXCTPACTGXY

SEQ ID NO: 1612 - protein, 14 aa, Artificial Sequence
  Synthetically generated peptide
  misc_feature (2)..(2): Xaa can be Cys or D-Cys
VXCEICCNPACTGC

SEQ ID NO: 1613 - protein, 15 aa, Artificial Sequence
  Synthetically generated peptide
  misc_feature (2)..(2): Xaa can be Cys or D-Cys
VXCEICCNPACTGCK

SEQ ID NO: 1614 - protein, 15 aa, Artificial Sequence
  Synthetically generated peptide
  misc_feature (2)..(2): Xaa can be Cys or D-Cys
VXCEICCNPACTGCY

SEQ ID NO: 1615 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
VXCEICCNPACTGX

SEQ ID NO: 1616 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
VXCEICCNPACTGXK

SEQ ID NO: 1617 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
VXCEICCNPACTGXY

SEQ ID NO: 1618 - protein, 14 aa, Artificial Sequence
  Synthetically generated peptide
  misc_feature (2)..(2): Xaa can be Cys or D-Cys
VXCEICCTPACTGC

SEQ ID NO: 1619 - protein, 15 aa, Artificial Sequence
  Synthetically generated peptide
  misc_feature (2)..(2): Xaa can be Cys or D-Cys
VXCEICCTPACTGCK

SEQ ID NO: 1620 - protein, 15 aa, Artificial Sequence
  Synthetically generated peptide
  misc_feature (2)..(2): Xaa can be Cys or D-Cys
VXCEICCTPACTGCY

SEQ ID NO: 1621 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
VXCEICCTPACTGX

SEQ ID NO: 1622 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
VXCEICCTPACTGXK

SEQ ID NO: 1623 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
VXCEICCTPACTGXY

SEQ ID NO: 1624 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
VXCEIXCNPACTGC

SEQ ID NO: 1625 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
VXCEIXCNPACTGCK

SEQ ID NO: 1626 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
VXCEIXCNPACTGCY

SEQ ID NO: 1627 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCEIXCNPACTGX

SEQ ID NO: 1628 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCEIXCNPACTGXK

SEQ ID NO: 1629 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCEIXCNPACTGXY

SEQ ID NO: 1630 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
VXCEIXCTPACTGC

SEQ ID NO: 1631 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
VXCEIXCTPACTGCK

SEQ ID NO: 1632 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
VXCEIXCTPACTGCY

SEQ ID NO: 1633 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCEIXCTPACTGX

SEQ ID NO: 1634 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCEIXCTPACTGXK

SEQ ID NO: 1635 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCEIXCTPACTGXY

SEQ ID NO: 1636 - protein, 14 aa, Artificial Sequence
  Synthetically generated peptide
  misc_feature (2)..(2): Xaa can be Cys or D-Cys
VXCELCCNPACTGC

SEQ ID NO: 1637 - protein, 15 aa, Artificial Sequence
  Synthetically generated peptide
  misc_feature (2)..(2): Xaa can be Cys or D-Cys
VXCELCCNPACTGCK

SEQ ID NO: 1638 - protein, 15 aa, Artificial Sequence
  Synthetically generated peptide
  misc_feature (2)..(2): Xaa can be Cys or D-Cys
VXCELCCNPACTGCY

SEQ ID NO: 1639 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
VXCELCCNPACTGX

SEQ ID NO: 1640 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
VXCELCCNPACTGXK

SEQ ID NO: 1641 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
VXCELCCNPACTGXY

SEQ ID NO: 1642 - protein, 14 aa, Artificial Sequence
  Synthetically generated peptide
  misc_feature (2)..(2): Xaa can be Cys or D-Cys
VXCELCCTPACTGC

SEQ ID NO: 1643 - protein, 15 aa, Artificial Sequence
  Synthetically generated peptide
  misc_feature (2)..(2): Xaa can be Cys or D-Cys
VXCELCCTPACTGCK

SEQ ID NO: 1644 - protein, 15 aa, Artificial Sequence
  Synthetically generated peptide
  misc_feature (2)..(2): Xaa can be Cys or D-Cys
VXCELCCTPACTGCY

SEQ ID NO: 1645 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
VXCELCCTPACTGX

SEQ ID NO: 1646 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
VXCELCCTPACTGXK

SEQ ID NO: 1647 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
VXCELCCTPACTGXY

SEQ ID NO: 1648 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
VXCELXCNPACTGC

SEQ ID NO: 1649 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
VXCELXCNPACTGCK

SEQ ID NO: 1650 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
VXCELXCNPACTGCY

SEQ ID NO: 1651 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCELXCNPACTGX

SEQ ID NO: 1652 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCELXCNPACTGXK

SEQ ID NO: 1653 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCELXCNPACTGXY

SEQ ID NO: 1654 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
VXCELXCTPACTGC

SEQ ID NO: 1655 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
VXCELXCTPACTGCK

SEQ ID NO: 1656 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
VXCELXCTPACTGCY

SEQ ID NO: 1657 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCELXCTPACTGX

SEQ ID NO: 1658 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCELXCTPACTGXK

SEQ ID NO: 1659 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCELXCTPACTGXY

SEQ ID NO: 1660 - protein, 14 aa, Artificial Sequence
  Synthetically generated peptide
  misc_feature (2)..(2): Xaa can be Cys or D-Cys
VXCEYCCNPACTGC

SEQ ID NO: 1661 - protein, 15 aa, Artificial Sequence
  Synthetically generated peptide
  misc_feature (2)..(2): Xaa can be Cys or D-Cys
VXCEYCCNPACTGCK

SEQ ID NO: 1662 - protein, 15 aa, Artificial Sequence
  Synthetically generated peptide
  misc_feature (2)..(2): Xaa can be Cys or D-Cys
VXCEYCCNPACTGCY

SEQ ID NO: 1663 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
VXCEYCCNPACTGX

SEQ ID NO: 1664 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
VXCEYCCNPACTGXK

SEQ ID NO: 1665 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
VXCEYCCNPACTGXY

SEQ ID NO: 1666 - protein, 14 aa, Artificial Sequence
  Synthetically generated peptide
  misc_feature (2)..(2): Xaa can be Cys or D-Cys
VXCEYCCTPACTGC

SEQ ID NO: 1667 - protein, 15 aa, Artificial Sequence
  Synthetically generated peptide
  misc_feature (2)..(2): Xaa can be Cys or D-Cys
VXCEYCCTPACTGCK

SEQ ID NO: 1668 - protein, 15 aa, Artificial Sequence
  Synthetically generated peptide
  misc_feature (2)..(2): Xaa can be Cys or D-Cys
VXCEYCCTPACTGCY

SEQ ID NO: 1669 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
VXCEYCCTPACTGX

SEQ ID NO: 1670 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
VXCEYCCTPACTGXK

SEQ ID NO: 1671 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
VXCEYCCTPACTGXY

SEQ ID NO: 1672 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
VXCEYXCNPACTGC

SEQ ID NO: 1673 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
VXCEYXCNPACTGCK

SEQ ID NO: 1674 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
VXCEYXCNPACTGCY

SEQ ID NO: 1675 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCEYXCNPACTGX

SEQ ID NO: 1676 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCEYXCNPACTGXK

SEQ ID NO: 1677 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCEYXCNPACTGXY

SEQ ID NO: 1678 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
VXCEYXCTPACTGC

SEQ ID NO: 1679 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
VXCEYXCTPACTGCK

SEQ ID NO: 1680 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
VXCEYXCTPACTGCY

SEQ ID NO: 1681 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCEYXCTPACTGX

SEQ ID NO: 1682 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCEYXCTPACTGXK

SEQ ID NO: 1683 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCEYXCTPACTGXY

SEQ ID NO: 1684 - protein, 14 aa, Artificial Sequence
  Synthetically generated peptide
  misc_feature (2)..(2): Xaa can be Cys or D-Cys
VXCEFCCNPACTGC

SEQ ID NO: 1685 - protein, 15 aa, Artificial Sequence
  Synthetically generated peptide
  misc_feature (2)..(2): Xaa can be Cys or D-Cys
VXCEFCCNPACTGCK

SEQ ID NO: 1686 - protein, 15 aa, Artificial Sequence
  Synthetically generated peptide
  misc_feature (2)..(2): Xaa can be Cys or D-Cys
VXCEFCCNPACTGCY

SEQ ID NO: 1687 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
VXCEFCCNPACTGX

SEQ ID NO: 1688 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
VXCEFCCNPACTGXK

SEQ ID NO: 1689 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
VXCEFCCNPACTGXY

SEQ ID NO: 1690 - protein, 14 aa, Artificial Sequence
  Synthetically generated peptide
  misc_feature (2)..(2): Xaa can be Cys or D-Cys
VXCEFCCTPACTGC

SEQ ID NO: 1691 - protein, 15 aa, Artificial Sequence
  Synthetically generated peptide
  misc_feature (2)..(2): Xaa can be Cys or D-Cys
VXCEFCCTPACTGCK

SEQ ID NO: 1692 - protein, 15 aa, Artificial Sequence
  Synthetically generated peptide
  misc_feature (2)..(2): Xaa can be Cys or D-Cys
VXCEFCCTPACTGCY

SEQ ID NO: 1693 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
VXCEFCCTPACTGX

SEQ ID NO: 1694 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
VXCEFCCTPACTGXK

SEQ ID NO: 1695 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
VXCEFCCTPACTGXY

SEQ ID NO: 1696 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
VXCEFXCNPACTGC

SEQ ID NO: 1697 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
VXCEFXCNPACTGCK

SEQ ID NO: 1698 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
VXCEFXCNPACTGCY

SEQ ID NO: 1699 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCEFXCNPACTGX

SEQ ID NO: 1700 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCEFXCNPACTGXK

SEQ ID NO: 1701 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCEFXCNPACTGXY

SEQ ID NO: 1702 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
VXCEFXCTPACTGC

SEQ ID NO: 1703 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
VXCEFXCTPACTGCK

SEQ ID NO: 1704 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
VXCEFXCTPACTGCY

SEQ ID NO: 1705 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCEFXCTPACTGX

SEQ ID NO: 1706 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCEFXCTPACTGXK

SEQ ID NO: 1707 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCEFXCTPACTGXY

SEQ ID NO: 1708 - protein, 14 aa, Artificial Sequence
  Synthetically generated peptide
  misc_feature (2)..(2): Xaa can be Cys or D-Cys
VXCEWCCNPACTGC

SEQ ID NO: 1709 - protein, 15 aa, Artificial Sequence
  Synthetically generated peptide
  misc_feature (2)..(2): Xaa can be Cys or D-Cys
VXCEWCCNPACTGCK

SEQ ID NO: 1710 - protein, 15 aa, Artificial Sequence
  Synthetically generated peptide
  misc_feature (2)..(2): Xaa can be Cys or D-Cys
VXCEWCCNPACTGCY

SEQ ID NO: 1711 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
VXCEWCCNPACTGX

SEQ ID NO: 1712 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
VXCEWCCNPACTGXK

SEQ ID NO: 1713 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
VXCEWCCNPACTGXY

SEQ ID NO: 1714 - protein, 14 aa, Artificial Sequence
  Synthetically generated peptide
  misc_feature (2)..(2): Xaa can be Cys or D-Cys
VXCEWCCTPACTGC

SEQ ID NO: 1715 - protein, 15 aa, Artificial Sequence
  Synthetically generated peptide
  misc_feature (2)..(2): Xaa can be Cys or D-Cys
VXCEWCCTPACTGCK

SEQ ID NO: 1716 - protein, 15 aa, Artificial Sequence
  Synthetically generated peptide
  misc_feature (2)..(2): Xaa can be Cys or D-Cys
VXCEWCCTPACTGCY

SEQ ID NO: 1717 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
VXCEWCCTPACTGX

SEQ ID NO: 1718 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
VXCEWCCTPACTGXK

SEQ ID NO: 1719 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
VXCEWCCTPACTGXY

SEQ ID NO: 1720 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
VXCEWXCNPACTGC

SEQ ID NO: 1721 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
VXCEWXCNPACTGCK

SEQ ID NO: 1722 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
VXCEWXCNPACTGCY

SEQ ID NO: 1723 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCEWXCNPACTGX

SEQ ID NO: 1724 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCEWXCNPACTGXK

SEQ ID NO: 1725 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCEWXCNPACTGXY

SEQ ID NO: 1726 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
VXCEWXCTPACTGC

SEQ ID NO: 1727 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
VXCEWXCTPACTGCK

SEQ ID NO: 1728 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
VXCEWXCTPACTGCY

SEQ ID NO: 1729 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCEWXCTPACTGX

SEQ ID NO: 1730 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCEWXCTPACTGXK

SEQ ID NO: 1731 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
VXCEWXCTPACTGXY

SEQ ID NO: 1732 - protein, 14 aa, Artificial Sequence
  Synthetically generated peptide
ACCEVCCNPACTGC

SEQ ID NO: 1733 - protein, 15 aa, Artificial Sequence
  Synthetically generated peptide
ACCEVCCNPACTGCK

SEQ ID NO: 1734 - protein, 15 aa, Artificial Sequence
  Synthetically generated peptide
ACCEVCCNPACTGCY

SEQ ID NO: 1735 - protein, 14 aa, Artificial Sequence
  Synthetically generated peptide
  misc_feature (14)..(14): Xaa can be Cys or D-Cys
ACCEVCCNPACTGX

SEQ ID NO: 1736 - protein, 15 aa, Artificial Sequence
  Synthetically generated peptide
  misc_feature (14)..(14): Xaa can be Cys or D-Cys
ACCEVCCNPACTGXK

SEQ ID NO: 1737 - protein, 15 aa, Artificial Sequence
  Synthetically generated peptide
  misc_feature (14)..(14): Xaa can be Cys or D-Cys
ACCEVCCNPACTGXY

SEQ ID NO: 1738 - protein, 14 aa, Artificial Sequence
  Synthetically generated peptide
ACCEVCCTPACTGC

SEQ ID NO: 1739 - protein, 15 aa, Artificial Sequence
  Synthetically generated peptide
ACCEVCCTPACTGCK

SEQ ID NO: 1740 - protein, 15 aa, Artificial Sequence
  Synthetically generated peptide
ACCEVCCTPACTGCY

SEQ ID NO: 1741 - protein, 14 aa, Artificial Sequence
  Synthetically generated peptide
  misc_feature (14)..(14): Xaa can be Cys or D-Cys
ACCEVCCTPACTGX

SEQ ID NO: 1742 - protein, 15 aa, Artificial Sequence
  Synthetically generated peptide
  misc_feature (14)..(14): Xaa can be Cys or D-Cys
ACCEVCCTPACTGXK

SEQ ID NO: 1743 - protein, 15 aa, Artificial Sequence
  Synthetically generated peptide
  misc_feature (14)..(14): Xaa can be Cys or D-Cys
ACCEVCCTPACTGXY

SEQ ID NO: 1744 - protein, 14 aa, Artificial Sequence
  Synthetically generated peptide
  misc_feature (6)..(6): Xaa can be Cys or D-Cys
ACCEVXCNPACTGC

SEQ ID NO: 1745 - protein, 15 aa, Artificial Sequence
  Synthetically generated peptide
  misc_feature (6)..(6): Xaa can be Cys or D-Cys
ACCEVXCNPACTGCK

SEQ ID NO: 1746 - protein, 15 aa, Artificial Sequence
  Synthetically generated peptide
  misc_feature (6)..(6): Xaa can be Cys or D-Cys
ACCEVXCNPACTGCY

SEQ ID NO: 1747 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
ACCEVXCNPACTGX

SEQ ID NO: 1748 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEVXCNPACTGXK

SEQ ID NO: 1749 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEVXCNPACTGXY

SEQ ID NO: 1750 - protein, 14 aa, Artificial Sequence
  Synthetically generated peptide
  misc_feature (6)..(6): Xaa can be Cys or D-Cys
ACCEVXCTPACTGC

SEQ ID NO: 1751 - protein, 15 aa, Artificial Sequence
  Synthetically generated peptide
  misc_feature (6)..(6): Xaa can be Cys or D-Cys
ACCEVXCTPACTGCK

SEQ ID NO: 1752 - protein, 15 aa, Artificial Sequence
  Synthetically generated peptide
  misc_feature (6)..(6): Xaa can be Cys or D-Cys
ACCEVXCTPACTGCY

SEQ ID NO: 1753 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
ACCEVXCTPACTGX

SEQ ID NO: 1754 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEVXCTPACTGXK

SEQ ID NO: 1755 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEVXCTPACTGXY

SEQ ID NO: 1756 - protein, 14 aa, Artificial Sequence
  Synthetically generated peptide
ACCEICCNPACTGC

SEQ ID NO: 1757 - protein, 15 aa, Artificial Sequence
  Synthetically generated peptide
ACCEICCNPACTGCK

SEQ ID NO: 1758 - protein, 15 aa, Artificial Sequence
  Synthetically generated peptide
ACCEICCNPACTGCY

SEQ ID NO: 1759 - protein, 14 aa, Artificial Sequence
  Synthetically generated peptide
  misc_feature (14)..(14): Xaa can be Cys or D-Cys
ACCEICCNPACTGX

SEQ ID NO: 1760 - protein, 15 aa, Artificial Sequence
  Synthetically generated peptide
  misc_feature (14)..(14): Xaa can be Cys or D-Cys
ACCEICCNPACTGXK

SEQ ID NO: 1761 - protein, 15 aa, Artificial Sequence
  Synthetically generated peptide
  misc_feature (14)..(14): Xaa can be Cys or D-Cys
ACCEICCNPACTGXY

SEQ ID NO: 1762 - protein, 14 aa, Artificial Sequence
  Synthetically generated peptide
ACCEICCTPACTGC

SEQ ID NO: 1763 - protein, 15 aa, Artificial Sequence
  Synthetically generated peptide
ACCEICCTPACTGCK

SEQ ID NO: 1764 - protein, 15 aa, Artificial Sequence
  Synthetically generated peptide
ACCEICCTPACTGCY

SEQ ID NO: 1765 - protein, 14 aa, Artificial Sequence
  Synthetically generated peptide
  misc_feature (14)..(14): Xaa can be Cys or D-Cys
ACCEICCTPACTGX

SEQ ID NO: 1766 - protein, 15 aa, Artificial Sequence
  Synthetically generated peptide
  misc_feature (14)..(14): Xaa can be Cys or D-Cys
ACCEICCTPACTGXK

SEQ ID NO: 1767 - protein, 15 aa, Artificial Sequence
  Synthetically generated peptide
  misc_feature (14)..(14): Xaa can be Cys or D-Cys
ACCEICCTPACTGXY

SEQ ID NO: 1768 - protein, 14 aa, Artificial Sequence
  Synthetically generated peptide
  misc_feature (6)..(6): Xaa can be Cys or D-Cys
ACCEIXCNPACTGC

SEQ ID NO: 1769 - protein, 15 aa, Artificial Sequence
  Synthetically generated peptide
  misc_feature (6)..(6): Xaa can be Cys or D-Cys
ACCEIXCNPACTGCK

SEQ ID NO: 1770 - protein, 15 aa, Artificial Sequence
  Synthetically generated peptide
  misc_feature (6)..(6): Xaa can be Cys or D-Cys
ACCEIXCNPACTGCY

SEQ ID NO: 1771 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
ACCEIXCNPACTGX

SEQ ID NO: 1772 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEIXCNPACTGXK

SEQ ID NO: 1773 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEIXCNPACTGXY

SEQ ID NO: 1774 - protein, 14 aa, Artificial Sequence
  Synthetically generated peptide
  misc_feature (6)..(6): Xaa can be Cys or D-Cys
ACCEIXCTPACTGC

SEQ ID NO: 1775 - protein, 15 aa, Artificial Sequence
  Synthetically generated peptide
  misc_feature (6)..(6): Xaa can be Cys or D-Cys
ACCEIXCTPACTGCK

SEQ ID NO: 1776 - protein, 15 aa, Artificial Sequence
  Synthetically generated peptide
  misc_feature (6)..(6): Xaa can be Cys or D-Cys
ACCEIXCTPACTGCY

SEQ ID NO: 1777 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
ACCEIXCTPACTGX

SEQ ID NO: 1778 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEIXCTPACTGXK

SEQ ID NO: 1779 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEIXCTPACTGXY

SEQ ID NO: 1780 - protein, 14 aa, Artificial Sequence
  Synthetically generated peptide
ACCELCCNPACTGC

SEQ ID NO: 1781 - protein, 15 aa, Artificial Sequence
  Synthetically generated peptide
ACCELCCNPACTGCK

SEQ ID NO: 1782 - protein, 15 aa, Artificial Sequence
  Synthetically generated peptide
ACCELCCNPACTGCY

SEQ ID NO: 1783 - protein, 14 aa, Artificial Sequence
  Synthetically generated peptide
  misc_feature (14)..(14): Xaa can be Cys or D-Cys
ACCELCCNPACTGX

SEQ ID NO: 1784 - protein, 15 aa, Artificial Sequence
  Synthetically generated peptide
  misc_feature (14)..(14): Xaa can be Cys or D-Cys
ACCELCCNPACTGXK

SEQ ID NO: 1785 - protein, 15 aa, Artificial Sequence
  Synthetically generated peptide
  misc_feature (14)..(14): Xaa can be Cys or D-Cys
ACCELCCNPACTGXY

SEQ ID NO: 1786 - protein, 14 aa, Artificial Sequence
  Synthetically generated peptide
ACCELCCTPACTGC

SEQ ID NO: 1787 - protein, 15 aa, Artificial Sequence
  Synthetically generated peptide
ACCELCCTPACTGCK

SEQ ID NO: 1788 - protein, 15 aa, Artificial Sequence
  Synthetically generated peptide
ACCELCCTPACTGCY

SEQ ID NO: 1789 - protein, 14 aa, Artificial Sequence
  Synthetically generated peptide
  misc_feature (14)..(14): Xaa can be Cys or D-Cys
ACCELCCTPACTGX

SEQ ID NO: 1790 - protein, 15 aa, Artificial Sequence
  Synthetically generated peptide
  misc_feature (14)..(14): Xaa can be Cys or D-Cys
ACCELCCTPACTGXK

SEQ ID NO: 1791 - protein, 15 aa, Artificial Sequence
  Synthetically generated peptide
  misc_feature (14)..(14): Xaa can be Cys or D-Cys
ACCELCCTPACTGXY

SEQ ID NO: 1792 - protein, 14 aa, Artificial Sequence
  Synthetically generated peptide
  misc_feature (6)..(6): Xaa can be Cys or D-Cys
ACCELXCNPACTGC

SEQ ID NO: 1793 - protein, 15 aa, Artificial Sequence
  Synthetically generated peptide
  misc_feature (6)..(6): Xaa can be Cys or D-Cys
ACCELXCNPACTGCK

SEQ ID NO: 1794 - protein, 15 aa, Artificial Sequence
  Synthetically generated peptide
  misc_feature (6)..(6): Xaa can be Cys or D-Cys
ACCELXCNPACTGCY

SEQ ID NO: 1795 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
ACCELXCNPACTGX

SEQ ID NO: 1796 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCELXCNPACTGXK

SEQ ID NO: 1797 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCELXCNPACTGXY

SEQ ID NO: 1798 - protein, 14 aa, Artificial Sequence
  Synthetically generated peptide
  misc_feature (6)..(6): Xaa can be Cys or D-Cys
ACCELXCTPACTGC

SEQ ID NO: 1799 - protein, 15 aa, Artificial Sequence
  Synthetically generated peptide
  misc_feature (6)..(6): Xaa can be Cys or D-Cys
ACCELXCTPACTGCK

SEQ ID NO: 1800 - protein, 15 aa, Artificial Sequence
  Synthetically generated peptide
  misc_feature (6)..(6): Xaa can be Cys or D-Cys
ACCELXCTPACTGCY

SEQ ID NO: 1801 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
ACCELXCTPACTGX

SEQ ID NO: 1802 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCELXCTPACTGXK

SEQ ID NO: 1803 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCELXCTPACTGXY

SEQ ID NO: 1804 - protein, 14 aa, Artificial Sequence
  Synthetically generated peptide
ACCEYCCNPACTGC

SEQ ID NO: 1805 - protein, 15 aa, Artificial Sequence
  Synthetically generated peptide
ACCEYCCNPACTGCK

SEQ ID NO: 1806 - protein, 15 aa, Artificial Sequence
  Synthetically generated peptide
ACCEYCCNPACTGCY

SEQ ID NO: 1807 - protein, 14 aa, Artificial Sequence
  Synthetically generated peptide
  misc_feature (14)..(14): Xaa can be Cys or D-Cys
ACCEYCCNPACTGX

SEQ ID NO: 1808 - protein, 15 aa, Artificial Sequence
  Synthetically generated peptide
  misc_feature (14)..(14): Xaa can be Cys or D-Cys
ACCEYCCNPACTGXK

SEQ ID NO: 1809 - protein, 15 aa, Artificial Sequence
  Synthetically generated peptide
  misc_feature (14)..(14): Xaa can be Cys or D-Cys
ACCEYCCNPACTGXY

SEQ ID NO: 1810 - protein, 14 aa, Artificial Sequence
  Synthetically generated peptide
ACCEYCCTPACTGC

SEQ ID NO: 1811 - protein, 15 aa, Artificial Sequence
  Synthetically generated peptide
ACCEYCCTPACTGCK

SEQ ID NO: 1812 - protein, 15 aa, Artificial Sequence
  Synthetically generated peptide
ACCEYCCTPACTGCY

SEQ ID NO: 1813 - protein, 14 aa, Artificial Sequence
  Synthetically generated peptide
  misc_feature (14)..(14): Xaa can be Cys or D-Cys
ACCEYCCTPACTGX

SEQ ID NO: 1814 - protein, 15 aa, Artificial Sequence
  Synthetically generated peptide
  misc_feature (14)..(14): Xaa can be Cys or D-Cys
ACCEYCCTPACTGXK

SEQ ID NO: 1815 - protein, 15 aa, Artificial Sequence
  Synthetically generated peptide
  misc_feature (14)..(14): Xaa can be Cys or D-Cys
ACCEYCCTPACTGXY

SEQ ID NO: 1816 - protein, 14 aa, Artificial Sequence
  Synthetically generated peptide
  misc_feature (6)..(6): Xaa can be Cys or D-Cys
ACCEYXCNPACTGC

SEQ ID NO: 1817 - protein, 15 aa, Artificial Sequence
  Synthetically generated peptide
  misc_feature (6)..(6): Xaa can be Cys or D-Cys
ACCEYXCNPACTGCK

SEQ ID NO: 1818 - protein, 15 aa, Artificial Sequence
  Synthetically generated peptide
  misc_feature (6)..(6): Xaa can be Cys or D-Cys
ACCEYXCNPACTGCY

SEQ ID NO: 1819 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
ACCEYXCNPACTGX

SEQ ID NO: 1820 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEYXCNPACTGXK

SEQ ID NO: 1821 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEYXCNPACTGXY

SEQ ID NO: 1822 - protein, 14 aa, Artificial Sequence
  Synthetically generated peptide
  misc_feature (6)..(6): Xaa can be Cys or D-Cys
ACCEYXCTPACTGC

SEQ ID NO: 1823 - protein, 15 aa, Artificial Sequence
  Synthetically generated peptide
  misc_feature (6)..(6): Xaa can be Cys or D-Cys
ACCEYXCTPACTGCK

SEQ ID NO: 1824 - protein, 15 aa, Artificial Sequence
  Synthetically generated peptide
  misc_feature (6)..(6): Xaa can be Cys or D-Cys
ACCEYXCTPACTGCY

SEQ ID NO: 1825 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
ACCEYXCTPACTGX

SEQ ID NO: 1826 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEYXCTPACTGXK

SEQ ID NO: 1827 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEYXCTPACTGXY

SEQ ID NO: 1828 - protein, 14 aa, Artificial Sequence
  Synthetically generated peptide
ACCEFCCNPACTGC

SEQ ID NO: 1829 - protein, 15 aa, Artificial Sequence
  Synthetically generated peptide
ACCEFCCNPACTGCK

SEQ ID NO: 1830 - protein, 15 aa, Artificial Sequence
  Synthetically generated peptide
ACCEFCCNPACTGCY

SEQ ID NO: 1831 - protein, 14 aa, Artificial Sequence
  Synthetically generated peptide
  misc_feature (14)..(14): Xaa can be Cys or D-Cys
ACCEFCCNPACTGX

SEQ ID NO: 1832 - protein, 15 aa, Artificial Sequence
  Synthetically generated peptide
  misc_feature (14)..(14): Xaa can be Cys or D-Cys
ACCEFCCNPACTGXK

SEQ ID NO: 1833 - protein, 15 aa, Artificial Sequence
  Synthetically generated peptide
  misc_feature (14)..(14): Xaa can be Cys or D-Cys
ACCEFCCNPACTGXY

SEQ ID NO: 1834 - protein, 14 aa, Artificial Sequence
  Synthetically generated peptide
ACCEFCCTPACTGC

SEQ ID NO: 1835 - protein, 15 aa, Artificial Sequence
  Synthetically generated peptide
ACCEFCCTPACTGCK

SEQ ID NO: 1836 - protein, 15 aa, Artificial Sequence
  Synthetically generated peptide
ACCEFCCTPACTGCY

SEQ ID NO: 1837 - protein, 14 aa, Artificial Sequence
  Synthetically generated peptide
  misc_feature (14)..(14): Xaa can be Cys or D-Cys
ACCEFCCTPACTGX

SEQ ID NO: 1838 - protein, 15 aa, Artificial Sequence
  Synthetically generated peptide
  misc_feature (14)..(14): Xaa can be Cys or D-Cys
ACCEFCCTPACTGXK

SEQ ID NO: 1839 - protein, 15 aa, Artificial Sequence
  Synthetically generated peptide
  misc_feature (14)..(14): Xaa can be Cys or D-Cys
ACCEFCCTPACTGXY

SEQ ID NO: 1840 - protein, 14 aa, Artificial Sequence
  Synthetically generated peptide
  misc_feature (6)..(6): Xaa can be Cys or D-Cys
ACCEFXCNPACTGC

SEQ ID NO: 1841 - protein, 15 aa, Artificial Sequence
  Synthetically generated peptide
  misc_feature (6)..(6): Xaa can be Cys or D-Cys
ACCEFXCNPACTGCK

SEQ ID NO: 1842 - protein, 15 aa, Artificial Sequence
  Synthetically generated peptide
  misc_feature (6)..(6): Xaa can be Cys or D-Cys
ACCEFXCNPACTGCY

SEQ ID NO: 1843 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
ACCEFXCNPACTGX

SEQ ID NO: 1844 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEFXCNPACTGXK

SEQ ID NO: 1845 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEFXCNPACTGXY

SEQ ID NO: 1846 - protein, 14 aa, Artificial Sequence
  Synthetically generated peptide
  misc_feature (6)..(6): Xaa can be Cys or D-Cys
ACCEFXCTPACTGC

SEQ ID NO: 1847 - protein, 15 aa, Artificial Sequence
  Synthetically generated peptide
  misc_feature (6)..(6): Xaa can be Cys or D-Cys
ACCEFXCTPACTGCK

SEQ ID NO: 1848 - protein, 15 aa, Artificial Sequence
  Synthetically generated peptide
  misc_feature (6)..(6): Xaa can be Cys or D-Cys
ACCEFXCTPACTGCY

SEQ ID NO: 1849 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
ACCEFXCTPACTGX

SEQ ID NO: 1850 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEFXCTPACTGXK

SEQ ID NO: 1851 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEFXCTPACTGXY

SEQ ID NO: 1852 - protein, 14 aa, Artificial Sequence
  Synthetically generated peptide
ACCEWCCNPACTGC

SEQ ID NO: 1853 - protein, 15 aa, Artificial Sequence
  Synthetically generated peptide
ACCEWCCNPACTGCK

SEQ ID NO: 1854 - protein, 15 aa, Artificial Sequence
  Synthetically generated peptide
ACCEWCCNPACTGCY

SEQ ID NO: 1855 - protein, 14 aa, Artificial Sequence
  Synthetically generated peptide
  misc_feature (14)..(14): Xaa can be Cys or D-Cys
ACCEWCCNPACTGX

SEQ ID NO: 1856 - protein, 15 aa, Artificial Sequence
  Synthetically generated peptide
  misc_feature (14)..(14): Xaa can be Cys or D-Cys
ACCEWCCNPACTGXK

SEQ ID NO: 1857 - protein, 15 aa, Artificial Sequence
  Synthetically generated peptide
  misc_feature (14)..(14): Xaa can be Cys or D-Cys
ACCEWCCNPACTGXY

SEQ ID NO: 1858 - protein, 14 aa, Artificial Sequence
  Synthetically generated peptide
ACCEWCCTPACTGC

SEQ ID NO: 1859 - protein, 15 aa, Artificial Sequence
  Synthetically generated peptide
ACCEWCCTPACTGCK

SEQ ID NO: 1860 - protein, 15 aa, Artificial Sequence
  Synthetically generated peptide
ACCEWCCTPACTGCY

SEQ ID NO: 1861 - protein, 14 aa, Artificial Sequence
  Synthetically generated peptide
  misc_feature (14)..(14): Xaa can be Cys or D-Cys
ACCEWCCTPACTGX

SEQ ID NO: 1862 - protein, 15 aa, Artificial Sequence
  Synthetically generated peptide
  misc_feature (14)..(14): Xaa can be Cys or D-Cys
ACCEWCCTPACTGXK

SEQ ID NO: 1863 - protein, 15 aa, Artificial Sequence
  Synthetically generated peptide
  misc_feature (14)..(14): Xaa can be Cys or D-Cys
ACCEWCCTPACTGXY

SEQ ID NO: 1864 - protein, 14 aa, Artificial Sequence
  Synthetically generated peptide
  misc_feature (6)..(6): Xaa can be Cys or D-Cys
ACCEWXCNPACTGC

SEQ ID NO: 1865 - protein, 15 aa, Artificial Sequence
  Synthetically generated peptide
  misc_feature (6)..(6): Xaa can be Cys or D-Cys
ACCEWXCNPACTGCK

SEQ ID NO: 1866 - protein, 15 aa, Artificial Sequence
  Synthetically generated peptide
  misc_feature (6)..(6): Xaa can be Cys or D-Cys
ACCEWXCNPACTGCY

SEQ ID NO: 1867 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
ACCEWXCNPACTGX

SEQ ID NO: 1868 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEWXCNPACTGXK

SEQ ID NO: 1869 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEWXCNPACTGXY

SEQ ID NO: 1870 - protein, 14 aa, Artificial Sequence
  Synthetically generated peptide
  misc_feature (6)..(6): Xaa can be Cys or D-Cys
ACCEWXCTPACTGC

SEQ ID NO: 1871 - protein, 15 aa, Artificial Sequence
  Synthetically generated peptide
  misc_feature (6)..(6): Xaa can be Cys or D-Cys
ACCEWXCTPACTGCK

SEQ ID NO: 1872 - protein, 15 aa, Artificial Sequence
  Synthetically generated peptide
  misc_feature (6)..(6): Xaa can be Cys or D-Cys
ACCEWXCTPACTGCY

SEQ ID NO: 1873 - protein, 14 aa, Artificial Sequence
  Synthetically generated peptide
  misc_feature (6)..(6): Xaa can be Cys or D-Cys
  misc_feature (14)..(14): Xaa can be Cys or D-Cys
ACCEWXCTPACTGX

SEQ ID NO: 1874 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEWXCTPACTGXK

SEQ ID NO: 1875 - protein, 15 aa, Artificial Sequence
  Synthetically generated peptide
  misc_feature (6)..(6): Xaa can be Cys or D-Cys
  misc_feature (14)..(14): Xaa can be Cys or D-Cys
ACCEWXCTPACTGXY

SEQ ID NO: 1876 - protein, 14 aa, Artificial Sequence
  Synthetically generated peptide
  misc_feature (2)..(2): Xaa can be Cys or D-Cys
AXCEVCCNPACTGC

SEQ ID NO: 1877 - protein, 15 aa, Artificial Sequence
  Synthetically generated peptide
  misc_feature (2)..(2): Xaa can be Cys or D-Cys
AXCEVCCNPACTGCK

SEQ ID NO: 1878 - protein, 15 aa, Artificial Sequence
  Synthetically generated peptide
  misc_feature (2)..(2): Xaa can be Cys or D-Cys
AXCEVCCNPACTGCY

SEQ ID NO: 1879 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
AXCEVCCNPACTGX

SEQ ID NO: 1880 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEVCCNPACTGXK

SEQ ID NO: 1881 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEVCCNPACTGXY

SEQ ID NO: 1882 - protein, 14 aa, Artificial Sequence
  Synthetically generated peptide
  misc_feature (2)..(2): Xaa can be Cys or D-Cys
AXCEVCCTPACTGC

SEQ ID NO: 1883 - protein, 15 aa, Artificial Sequence
  Synthetically generated peptide
  misc_feature (2)..(2): Xaa can be Cys or D-Cys
AXCEVCCTPACTGCK

SEQ ID NO: 1884 - protein, 15 aa, Artificial Sequence
  Synthetically generated peptide
  misc_feature (2)..(2): Xaa can be Cys or D-Cys
AXCEVCCTPACTGCY

SEQ ID NO: 1885 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
AXCEVCCTPACTGX

SEQ ID NO: 1886 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEVCCTPACTGXK

SEQ ID NO: 1887 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEVCCTPACTGXY

SEQ ID NO: 1888 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
AXCEVXCNPACTGC

SEQ ID NO: 1889 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEVXCNPACTGCK

SEQ ID NO: 1890 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEVXCNPACTGCY

SEQ ID NO: 1891 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEVXCNPACTGX

SEQ ID NO: 1892 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEVXCNPACTGXK

SEQ ID NO: 1893 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEVXCNPACTGXY

SEQ ID NO: 1894 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
AXCEVXCTPACTGC

SEQ ID NO: 1895 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEVXCTPACTGCK

SEQ ID NO: 1896 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEVXCTPACTGCY

SEQ ID NO: 1897 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEVXCTPACTGX

SEQ ID NO: 1898 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEVXCTPACTGXK

SEQ ID NO: 1899 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEVXCTPACTGXY

SEQ ID NO: 1900 - protein, 14 aa, Artificial Sequence
  Synthetically generated peptide
  misc_feature (2)..(2): Xaa can be Cys or D-Cys
AXCEICCNPACTGC

SEQ ID NO: 1901 - protein, 15 aa, Artificial Sequence
  Synthetically generated peptide
  misc_feature (2)..(2): Xaa can be Cys or D-Cys
AXCEICCNPACTGCK

SEQ ID NO: 1902 - protein, 15 aa, Artificial Sequence
  Synthetically generated peptide
  misc_feature (2)..(2): Xaa can be Cys or D-Cys
AXCEICCNPACTGCY

SEQ ID NO: 1903 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
AXCEICCNPACTGX

SEQ ID NO: 1904 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEICCNPACTGXK

SEQ ID NO: 1905 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEICCNPACTGXY

SEQ ID NO: 1906 - protein, 14 aa, Artificial Sequence
  Synthetically generated peptide
  misc_feature (2)..(2): Xaa can be Cys or D-Cys
AXCEICCTPACTGC

SEQ ID NO: 1907 - protein, 15 aa, Artificial Sequence
  Synthetically generated peptide
  misc_feature (2)..(2): Xaa can be Cys or D-Cys
AXCEICCTPACTGCK

SEQ ID NO: 1908 - protein, 15 aa, Artificial Sequence
  Synthetically generated peptide
  misc_feature (2)..(2): Xaa can be Cys or D-Cys
AXCEICCTPACTGCY

SEQ ID NO: 1909 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
AXCEICCTPACTGX

SEQ ID NO: 1910 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEICCTPACTGXK

SEQ ID NO: 1911 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEICCTPACTGXY

SEQ ID NO: 1912 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
AXCEIXCNPACTGC

SEQ ID NO: 1913 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEIXCNPACTGCK

SEQ ID NO: 1914 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEIXCNPACTGCY

SEQ ID NO: 1915 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEIXCNPACTGX

SEQ ID NO: 1916 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEIXCNPACTGXK

SEQ ID NO: 1917 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEIXCNPACTGXY

SEQ ID NO: 1918 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
AXCEIXCTPACTGC

SEQ ID NO: 1919 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEIXCTPACTGCK

SEQ ID NO: 1920 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEIXCTPACTGCY

SEQ ID NO: 1921 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEIXCTPACTGX

SEQ ID NO: 1922 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEIXCTPACTGXK

SEQ ID NO: 1923 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEIXCTPACTGXY

SEQ ID NO: 1924 - protein, 14 aa, Artificial Sequence
  Synthetically generated peptide
  misc_feature (2)..(2): Xaa can be Cys or D-Cys
AXCELCCNPACTGC

SEQ ID NO: 1925 - protein, 15 aa, Artificial Sequence
  Synthetically generated peptide
  misc_feature (2)..(2): Xaa can be Cys or D-Cys
AXCELCCNPACTGCK

SEQ ID NO: 1926 - protein, 15 aa, Artificial Sequence
  Synthetically generated peptide
  misc_feature (2)..(2): Xaa can be Cys or D-Cys
AXCELCCNPACTGCY

SEQ ID NO: 1927 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
AXCELCCNPACTGX

SEQ ID NO: 1928 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCELCCNPACTGXK

SEQ ID NO: 1929 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCELCCNPACTGXY

SEQ ID NO: 1930 - protein, 14 aa, Artificial Sequence
  Synthetically generated peptide
  misc_feature (2)..(2): Xaa can be Cys or D-Cys
AXCELCCTPACTGC

SEQ ID NO: 1931 - protein, 15 aa, Artificial Sequence
  Synthetically generated peptide
  misc_feature (2)..(2): Xaa can be Cys or D-Cys
AXCELCCTPACTGCK

SEQ ID NO: 1932 - protein, 15 aa, Artificial Sequence
  Synthetically generated peptide
  misc_feature (2)..(2): Xaa can be Cys or D-Cys
AXCELCCTPACTGCY

SEQ ID NO: 1933 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
AXCELCCTPACTGX

SEQ ID NO: 1934 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCELCCTPACTGXK

SEQ ID NO: 1935 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCELCCTPACTGXY

SEQ ID NO: 1936 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
AXCELXCNPACTGC

SEQ ID NO: 1937 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCELXCNPACTGCK

SEQ ID NO: 1938 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCELXCNPACTGCY

SEQ ID NO: 1939 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCELXCNPACTGX

SEQ ID NO: 1940 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCELXCNPACTGXK

SEQ ID NO: 1941 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCELXCNPACTGXY

SEQ ID NO: 1942 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
AXCELXCTPACTGC

SEQ ID NO: 1943 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCELXCTPACTGCK

SEQ ID NO: 1944 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCELXCTPACTGCY

SEQ ID NO: 1945 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCELXCTPACTGX

SEQ ID NO: 1946 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCELXCTPACTGXK

SEQ ID NO: 1947 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCELXCTPACTGXY

SEQ ID NO: 1948 - protein, 14 aa, Artificial Sequence
  Synthetically generated peptide
  misc_feature (2)..(2): Xaa can be Cys or D-Cys
AXCEYCCNPACTGC

SEQ ID NO: 1949 - protein, 15 aa, Artificial Sequence
  Synthetically generated peptide
  misc_feature (2)..(2): Xaa can be Cys or D-Cys
AXCEYCCNPACTGCK

SEQ ID NO: 1950 - protein, 15 aa, Artificial Sequence
  Synthetically generated peptide
  misc_feature (2)..(2): Xaa can be Cys or D-Cys
AXCEYCCNPACTGCY

SEQ ID NO: 1951 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
AXCEYCCNPACTGX

SEQ ID NO: 1952 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEYCCNPACTGXK

SEQ ID NO: 1953 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEYCCNPACTGXY

SEQ ID NO: 1954 - protein, 14 aa, Artificial Sequence
  Synthetically generated peptide
  misc_feature (2)..(2): Xaa can be Cys or D-Cys
AXCEYCCTPACTGC

SEQ ID NO: 1955 - protein, 15 aa, Artificial Sequence
  Synthetically generated peptide
  misc_feature (2)..(2): Xaa can be Cys or D-Cys
AXCEYCCTPACTGCK

SEQ ID NO: 1956 - protein, 15 aa, Artificial Sequence
  Synthetically generated peptide
  misc_feature (2)..(2): Xaa can be Cys or D-Cys
AXCEYCCTPACTGCY

SEQ ID NO: 1957 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
AXCEYCCTPACTGX

SEQ ID NO: 1958 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEYCCTPACTGXK

SEQ ID NO: 1959 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEYCCTPACTGXY

SEQ ID NO: 1960 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
AXCEYXCNPACTGC

SEQ ID NO: 1961 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEYXCNPACTGCK

SEQ ID NO: 1962 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEYXCNPACTGCY

SEQ ID NO: 1963 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEYXCNPACTGX

SEQ ID NO: 1964 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEYXCNPACTGXK

SEQ ID NO: 1965 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEYXCNPACTGXY

SEQ ID NO: 1966 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
AXCEYXCTPACTGC

SEQ ID NO: 1967 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEYXCTPACTGCK

SEQ ID NO: 1968 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEYXCTPACTGCY

SEQ ID NO: 1969 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEYXCTPACTGX

SEQ ID NO: 1970 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEYXCTPACTGXK

SEQ ID NO: 1971 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEYXCTPACTGXY

SEQ ID NO: 1972 - protein, 14 aa, Artificial Sequence
  Synthetically generated peptide
  misc_feature (2)..(2): Xaa can be Cys or D-Cys
AXCEFCCNPACTGC

SEQ ID NO: 1973 - protein, 15 aa, Artificial Sequence
  Synthetically generated peptide
  misc_feature (2)..(2): Xaa can be Cys or D-Cys
AXCEFCCNPACTGCK

SEQ ID NO: 1974 - protein, 15 aa, Artificial Sequence
  Synthetically generated peptide
  misc_feature (2)..(2): Xaa can be Cys or D-Cys
AXCEFCCNPACTGCY

SEQ ID NO: 1975 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
AXCEFCCNPACTGX

SEQ ID NO: 1976 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEFCCNPACTGXK

SEQ ID NO: 1977 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEFCCNPACTGXY

SEQ ID NO: 1978 - protein, 14 aa, Artificial Sequence
  Synthetically generated peptide
  misc_feature (2)..(2): Xaa can be Cys or D-Cys
AXCEFCCTPACTGC

SEQ ID NO: 1979 - protein, 15 aa, Artificial Sequence
  Synthetically generated peptide
  misc_feature (2)..(2): Xaa can be Cys or D-Cys
AXCEFCCTPACTGCK

SEQ ID NO: 1980 - protein, 15 aa, Artificial Sequence
  Synthetically generated peptide
  misc_feature (2)..(2): Xaa can be Cys or D-Cys
AXCEFCCTPACTGCY

SEQ ID NO: 1981 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
AXCEFCCTPACTGX

SEQ ID NO: 1982 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEFCCTPACTGXK

SEQ ID NO: 1983 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEFCCTPACTGXY

SEQ ID NO: 1984 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
AXCEFXCNPACTGC

SEQ ID NO: 1985 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEFXCNPACTGCK

SEQ ID NO: 1986 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEFXCNPACTGCY

SEQ ID NO: 1987 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEFXCNPACTGX

SEQ ID NO: 1988 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEFXCNPACTGXK

SEQ ID NO: 1989 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEFXCNPACTGXY

SEQ ID NO: 1990 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
AXCEFXCTPACTGC

SEQ ID NO: 1991 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEFXCTPACTGCK

SEQ ID NO: 1992 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEFXCTPACTGCY

SEQ ID NO: 1993 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEFXCTPACTGX

SEQ ID NO: 1994 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEFXCTPACTGXK

SEQ ID NO: 1995 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEFXCTPACTGXY

SEQ ID NO: 1996 - protein, 14 aa, Artificial Sequence
  Synthetically generated peptide
  misc_feature (2)..(2): Xaa can be Cys or D-Cys
AXCEWCCNPACTGC

SEQ ID NO: 1997 - protein, 15 aa, Artificial Sequence
  Synthetically generated peptide
  misc_feature (2)..(2): Xaa can be Cys or D-Cys
AXCEWCCNPACTGCK

SEQ ID NO: 1998 - protein, 15 aa, Artificial Sequence
  Synthetically generated peptide
  misc_feature (2)..(2): Xaa can be Cys or D-Cys
AXCEWCCNPACTGCY

SEQ ID NO: 1999 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
AXCEWCCNPACTGX

SEQ ID NO: 2000 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEWCCNPACTGXK

SEQ ID NO: 2001 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEWCCNPACTGXY

SEQ ID NO: 2002 - protein, 14 aa, Artificial Sequence
  Synthetically generated peptide
  misc_feature (2)..(2): Xaa can be Cys or D-Cys
AXCEWCCTPACTGC

SEQ ID NO: 2003 - protein, 15 aa, Artificial Sequence
  Synthetically generated peptide
  misc_feature (2)..(2): Xaa can be Cys or D-Cys
AXCEWCCTPACTGCK

SEQ ID NO: 2004 - protein, 15 aa, Artificial Sequence
  Synthetically generated peptide
  misc_feature (2)..(2): Xaa can be Cys or D-Cys
AXCEWCCTPACTGCY

SEQ ID NO: 2005 - protein, 14 aa, Artificial Sequence
  Synthetically generated peptide
  misc_feature (2)..(2): Xaa can be Cys or D-Cys
  misc_feature (14)..(14): Xaa can be Cys or D-Cys
AXCEWCCTPACTGX

SEQ ID NO: 2006 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEWCCTPACTGXK

SEQ ID NO: 2007 - protein, 15 aa, Artificial Sequence
  Synthetically generated peptide
  misc_feature (2)..(2): Xaa can be Cys or D-Cys
  misc_feature (14)..(14): Xaa can be Cys or D-Cys
AXCEWCCTPACTGXY

SEQ ID NO: 2008 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
AXCEWXCNPACTGC

SEQ ID NO: 2009 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEWXCNPACTGCK

SEQ ID NO: 2010 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEWXCNPACTGCY

SEQ ID NO: 2011 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEWXCNPACTGX

SEQ ID NO: 2012 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEWXCNPACTGXK

SEQ ID NO: 2013 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEWXCNPACTGXY

SEQ ID NO: 2014 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
AXCEWXCTPACTGC

SEQ ID NO: 2015 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEWXCTPACTGCK

SEQ ID NO: 2016 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
AXCEWXCTPACTGCY

SEQ ID NO: 2017 - protein, 14 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEWXCTPACTGX

SEQ ID NO: 2018 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEWXCTPACTGXK

SEQ ID NO: 2019 - protein, 15 aa, Artificial Sequence
  Synthetically generated peptide
  misc_feature (2)..(2): Xaa can be Cys or D-Cys
  misc_feature (6)..(6): Xaa can be Cys or D-Cys
  misc_feature (14)..(14): Xaa can be Cys or D-Cys
AXCEWXCTPACTGXY

SEQ ID NO: 2020 - protein, 15 aa, Artificial Sequence
  Synthetically generated peptide
AACCEVCCNPACTGC

SEQ ID NO: 2021 - protein, 16 aa, Artificial Sequence
  Synthetically generated peptide
AACCEVCCNPACTGCK

SEQ ID NO: 2022 - protein, 16 aa, Artificial Sequence
  Synthetically generated peptide
AACCEVCCNPACTGCY

SEQ ID NO: 2023 - protein, 15 aa, Artificial Sequence
  Synthetically generated peptide
  misc_feature (15)..(15): Xaa can be Cys or D-Cys
AACCEVCCNPACTGX

SEQ ID NO: 2024 - protein, 16 aa, Artificial Sequence
  Synthetically generated peptide
  misc_feature (15)..(15): Xaa can be Cys or D-Cys
AACCEVCCNPACTGXK

SEQ ID NO: 2025 - protein, 16 aa, Artificial Sequence
  Synthetically generated peptide
  misc_feature (15)..(15): Xaa can be Cys or D-Cys
AACCEVCCNPACTGXY

SEQ ID NO: 2026 - protein, 15 aa, Artificial Sequence
  Synthetically generated peptide
AACCEVCCTPACTGC

SEQ ID NO: 2027 - protein, 16 aa, Artificial Sequence
  Synthetically generated peptide
AACCEVCCTPACTGCK

SEQ ID NO: 2028 - protein, 16 aa, Artificial Sequence
  Synthetically generated peptide
AACCEVCCTPACTGCY

SEQ ID NO: 2029 - protein, 15 aa, Artificial Sequence
  Synthetically generated peptide
  misc_feature (15)..(15): Xaa can be Cys or D-Cys
AACCEVCCTPACTGX

SEQ ID NO: 2030 - protein, 16 aa, Artificial Sequence
  Synthetically generated peptide
  misc_feature (15)..(15): Xaa can be Cys or D-Cys
AACCEVCCTPACTGXK

SEQ ID NO: 2031 - protein, 16 aa, Artificial Sequence
  Synthetically generated peptide
  misc_feature (15)..(15): Xaa can be Cys or D-Cys
AACCEVCCTPACTGXY

SEQ ID NO: 2032 - protein, 15 aa, Artificial Sequence
  Synthetically generated peptide
  misc_feature (7)..(7): Xaa can be Cys or D-Cys
AACCEVXCNPACTGC

SEQ ID NO: 2033 - protein, 16 aa, Artificial Sequence
  Synthetically generated peptide
  misc_feature (7)..(7): Xaa can be Cys or D-Cys
AACCEVXCNPACTGCK

SEQ ID NO: 2034 - protein, 16 aa, Artificial Sequence
  Synthetically generated peptide
  misc_feature (7)..(7): Xaa can be Cys or D-Cys
AACCEVXCNPACTGCY

SEQ ID NO: 2035 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AACCEVXCNPACTGX

SEQ ID NO: 2036 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AACCEVXCNPACTGXK

SEQ ID NO: 2037 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AACCEVXCNPACTGXY

SEQ ID NO: 2038 - protein, 15 aa, Artificial Sequence
  Synthetically generated peptide
  misc_feature (7)..(7): Xaa can be Cys or D-Cys
AACCEVXCTPACTGC

SEQ ID NO: 2039 - protein, 16 aa, Artificial Sequence
  Synthetically generated peptide
  misc_feature (7)..(7): Xaa can be Cys or D-Cys
AACCEVXCTPACTGCK

SEQ ID NO: 2040 - protein, 16 aa, Artificial Sequence
  Synthetically generated peptide
  misc_feature (7)..(7): Xaa can be Cys or D-Cys
AACCEVXCTPACTGCY

SEQ ID NO: 2041 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AACCEVXCTPACTGX

SEQ ID NO: 2042 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AACCEVXCTPACTGXK

SEQ ID NO: 2043 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AACCEVXCTPACTGXY

SEQ ID NO: 2044 - protein, 15 aa, Artificial Sequence
  Synthetically generated peptide
AACCEICCNPACTGC

SEQ ID NO: 2045 - protein, 16 aa, Artificial Sequence
  Synthetically generated peptide
AACCEICCNPACTGCK

SEQ ID NO: 2046 - protein, 16 aa, Artificial Sequence
  Synthetically generated peptide
AACCEICCNPACTGCY

SEQ ID NO: 2047 - protein, 15 aa, Artificial Sequence
  Synthetically generated peptide
  misc_feature (15)..(15): Xaa can be Cys or D-Cys
AACCEICCNPACTGX

SEQ ID NO: 2048 - protein, 16 aa, Artificial Sequence
  Synthetically generated peptide
  misc_feature (15)..(15): Xaa can be Cys or D-Cys
AACCEICCNPACTGXK

SEQ ID NO: 2049 - protein, 16 aa, Artificial Sequence
  Synthetically generated peptide
  misc_feature (15)..(15): Xaa can be Cys or D-Cys
AACCEICCNPACTGXY

SEQ ID NO: 2050 - protein, 15 aa, Artificial Sequence
  Synthetically generated peptide
AACCEICCTPACTGC

SEQ ID NO: 2051 - protein, 16 aa, Artificial Sequence
  Synthetically generated peptide
AACCEICCTPACTGCK

SEQ ID NO: 2052 - protein, 16 aa, Artificial Sequence
  Synthetically generated peptide
AACCEICCTPACTGCY

SEQ ID NO: 2053 - protein, 15 aa, Artificial Sequence
  Synthetically generated peptide
  misc_feature (15)..(15): Xaa can be Cys or D-Cys
AACCEICCTPACTGX

SEQ ID NO: 2054 - protein, 16 aa, Artificial Sequence
  Synthetically generated peptide
  misc_feature (15)..(15): Xaa can be Cys or D-Cys
AACCEICCTPACTGXK

SEQ ID NO: 2055 - protein, 16 aa, Artificial Sequence
  Synthetically generated peptide
  misc_feature (15)..(15): Xaa can be Cys or D-Cys
AACCEICCTPACTGXY

SEQ ID NO: 2056 - protein, 15 aa, Artificial Sequence
  Synthetically generated peptide
  misc_feature (7)..(7): Xaa can be Cys or D-Cys
AACCEIXCNPACTGC

SEQ ID NO: 2057 - protein, 16 aa, Artificial Sequence
  Synthetically generated peptide
  misc_feature (7)..(7): Xaa can be Cys or D-Cys
AACCEIXCNPACTGCK

SEQ ID NO: 2058 - protein, 16 aa, Artificial Sequence
  Synthetically generated peptide
  misc_feature (7)..(7): Xaa can be Cys or D-Cys
AACCEIXCNPACTGCY

SEQ ID NO: 2059 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AACCEIXCNPACTGX

SEQ ID NO: 2060 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AACCEIXCNPACTGXK

SEQ ID NO: 2061 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AACCEIXCNPACTGXY

SEQ ID NO: 2062 - protein, 15 aa, Artificial Sequence
  Synthetically generated peptide
  misc_feature (7)..(7): Xaa can be Cys or D-Cys
AACCEIXCTPACTGC

SEQ ID NO: 2063 - protein, 16 aa, Artificial Sequence
  Synthetically generated peptide
  misc_feature (7)..(7): Xaa can be Cys or D-Cys
AACCEIXCTPACTGCK

SEQ ID NO: 2064 - protein, 16 aa, Artificial Sequence
  Synthetically generated peptide
  misc_feature (7)..(7): Xaa can be Cys or D-Cys
AACCEIXCTPACTGCY

SEQ ID NO: 2065 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AACCEIXCTPACTGX

SEQ ID NO: 2066 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AACCEIXCTPACTGXK

SEQ ID NO: 2067 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AACCEIXCTPACTGXY

SEQ ID NO: 2068 - protein, 15 aa, Artificial Sequence
  Synthetically generated peptide
AACCELCCNPACTGC

SEQ ID NO: 2069 - protein, 16 aa, Artificial Sequence
  Synthetically generated peptide
AACCELCCNPACTGCK

SEQ ID NO: 2070 - protein, 16 aa, Artificial Sequence
  Synthetically generated peptide
AACCELCCNPACTGCY

SEQ ID NO: 2071 - protein, 15 aa, Artificial Sequence
  Synthetically generated peptide
  misc_feature (15)..(15): Xaa can be Cys or D-Cys
AACCELCCNPACTGX

SEQ ID NO: 2072 - protein, 16 aa, Artificial Sequence
  Synthetically generated peptide
  misc_feature (15)..(15): Xaa can be Cys or D-Cys
AACCELCCNPACTGXK

SEQ ID NO: 2073 - protein, 16 aa, Artificial Sequence
  Synthetically generated peptide
  misc_feature (15)..(15): Xaa can be Cys or D-Cys
AACCELCCNPACTGXY

SEQ ID NO: 2074 - protein, 15 aa, Artificial Sequence
  Synthetically generated peptide
AACCELCCTPACTGC

SEQ ID NO: 2075 - protein, 16 aa, Artificial Sequence
  Synthetically generated peptide
AACCELCCTPACTGCK

SEQ ID NO: 2076 - protein, 16 aa, Artificial Sequence
  Synthetically generated peptide
AACCELCCTPACTGCY

SEQ ID NO: 2077 - protein, 15 aa, Artificial Sequence
  Synthetically generated peptide
  misc_feature (15)..(15): Xaa can be Cys or D-Cys
AACCELCCTPACTGX

SEQ ID NO: 2078 - protein, 16 aa, Artificial Sequence
  Synthetically generated peptide
  misc_feature (15)..(15): Xaa can be Cys or D-Cys
AACCELCCTPACTGXK

SEQ ID NO: 2079 - protein, 16 aa, Artificial Sequence
  Synthetically generated peptide
  misc_feature (15)..(15): Xaa can be Cys or D-Cys
AACCELCCTPACTGXY

SEQ ID NO: 2080 - protein, 15 aa, Artificial Sequence
  Synthetically generated peptide
  misc_feature (7)..(7): Xaa can be Cys or D-Cys
AACCELXCNPACTGC

SEQ ID NO: 2081 - protein, 16 aa, Artificial Sequence
  Synthetically generated peptide
  misc_feature (7)..(7): Xaa can be Cys or D-Cys
AACCELXCNPACTGCK

SEQ ID NO: 2082 - protein, 16 aa, Artificial Sequence
  Synthetically generated peptide
  misc_feature (7)..(7): Xaa can be Cys or D-Cys
AACCELXCNPACTGCY

SEQ ID NO: 2083 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AACCELXCNPACTGX

SEQ ID NO: 2084 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AACCELXCNPACTGXK

SEQ ID NO: 2085 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AACCELXCNPACTGXY

SEQ ID NO: 2086 - protein, 15 aa, Artificial Sequence
  Synthetically generated peptide
  misc_feature (7)..(7): Xaa can be Cys or D-Cys
AACCELXCTPACTGC

SEQ ID NO: 2087 - protein, 16 aa, Artificial Sequence
  Synthetically generated peptide
  misc_feature (7)..(7): Xaa can be Cys or D-Cys
AACCELXCTPACTGCK

SEQ ID NO: 2088 - protein, 16 aa, Artificial Sequence
  Synthetically generated peptide
  misc_feature (7)..(7): Xaa can be Cys or D-Cys
AACCELXCTPACTGCY

SEQ ID NO: 2089 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AACCELXCTPACTGX

SEQ ID NO: 2090 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AACCELXCTPACTGXK

SEQ ID NO: 2091 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AACCELXCTPACTGXY

SEQ ID NO: 2092 - protein, 15 aa, Artificial Sequence
  Synthetically generated peptide
AACCEYCCNPACTGC

SEQ ID NO: 2093 - protein, 16 aa, Artificial Sequence
  Synthetically generated peptide
AACCEYCCNPACTGCK

SEQ ID NO: 2094 - protein, 16 aa, Artificial Sequence
  Synthetically generated peptide
AACCEYCCNPACTGCY

SEQ ID NO: 2095 - protein, 15 aa, Artificial Sequence
  Synthetically generated peptide
  misc_feature (15)..(15): Xaa can be Cys or D-Cys
AACCEYCCNPACTGX

SEQ ID NO: 2096 - protein, 16 aa, Artificial Sequence
  Synthetically generated peptide
  misc_feature (15)..(15): Xaa can be Cys or D-Cys
AACCEYCCNPACTGXK

SEQ ID NO: 2097 - protein, 16 aa, Artificial Sequence
  Synthetically generated peptide
  misc_feature (15)..(15): Xaa can be Cys or D-Cys
AACCEYCCNPACTGXY

SEQ ID NO: 2098 - protein, 15 aa, Artificial Sequence
  Synthetically generated peptide
AACCEYCCTPACTGC

SEQ ID NO: 2099 - protein, 16 aa, Artificial Sequence
  Synthetically generated peptide
AACCEYCCTPACTGCK

SEQ ID NO: 2100 - protein, 16 aa, Artificial Sequence
  Synthetically generated peptide
AACCEYCCTPACTGCY

SEQ ID NO: 2101 - protein, 15 aa, Artificial Sequence
  Synthetically generated peptide
  misc_feature (15)..(15): Xaa can be Cys or D-Cys
AACCEYCCTPACTGX

SEQ ID NO: 2102 - protein, 16 aa, Artificial Sequence
  Synthetically generated peptide
  misc_feature (15)..(15): Xaa can be Cys or D-Cys
AACCEYCCTPACTGXK

SEQ ID NO: 2103 - protein, 16 aa, Artificial Sequence
  Synthetically generated peptide
  misc_feature (15)..(15): Xaa can be Cys or D-Cys
AACCEYCCTPACTGXY

SEQ ID NO: 2104 - protein, 15 aa, Artificial Sequence
  Synthetically generated peptide
  misc_feature (7)..(7): Xaa can be Cys or D-Cys
AACCEYXCNPACTGC

SEQ ID NO: 2105 - protein, 16 aa, Artificial Sequence
  Synthetically generated peptide
  misc_feature (7)..(7): Xaa can be Cys or D-Cys
AACCEYXCNPACTGCK

SEQ ID NO: 2106 - protein, 16 aa, Artificial Sequence
  Synthetically generated peptide
  misc_feature (7)..(7): Xaa can be Cys or D-Cys
AACCEYXCNPACTGCY

SEQ ID NO: 2107 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AACCEYXCNPACTGX

SEQ ID NO: 2108 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AACCEYXCNPACTGXK

SEQ ID NO: 2109 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AACCEYXCNPACTGXY

SEQ ID NO: 2110 - protein, 15 aa, Artificial Sequence
  Synthetically generated peptide
  misc_feature (7)..(7): Xaa can be Cys or D-Cys
AACCEYXCTPACTGC

SEQ ID NO: 2111 - protein, 16 aa, Artificial Sequence
  Synthetically generated peptide
  misc_feature (7)..(7): Xaa can be Cys or D-Cys
AACCEYXCTPACTGCK

SEQ ID NO: 2112 - protein, 16 aa, Artificial Sequence
  Synthetically generated peptide
  misc_feature (7)..(7): Xaa can be Cys or D-Cys
AACCEYXCTPACTGCY

SEQ ID NO: 2113 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AACCEYXCTPACTGX

SEQ ID NO: 2114 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AACCEYXCTPACTGXK

SEQ ID NO: 2115 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AACCEYXCTPACTGXY

SEQ ID NO: 2116 - protein, 15 aa, Artificial Sequence
  Synthetically generated peptide
AACCEFCCNPACTGC

SEQ ID NO: 2117 - protein, 16 aa, Artificial Sequence
  Synthetically generated peptide
AACCEFCCNPACTGCK

SEQ ID NO: 2118 - protein, 16 aa, Artificial Sequence
  Synthetically generated peptide
AACCEFCCNPACTGCY

SEQ ID NO: 2119 - protein, 15 aa, Artificial Sequence
  Synthetically generated peptide
  misc_feature (15)..(15): Xaa can be Cys or D-Cys
AACCEFCCNPACTGX

SEQ ID NO: 2120 - protein, 16 aa, Artificial Sequence
  Synthetically generated peptide
  misc_feature (15)..(15): Xaa can be Cys or D-Cys
AACCEFCCNPACTGXK

SEQ ID NO: 2121 - protein, 16 aa, Artificial Sequence
  Synthetically generated peptide
  misc_feature (15)..(15): Xaa can be Cys or D-Cys
AACCEFCCNPACTGXY

SEQ ID NO: 2122 - protein, 15 aa, Artificial Sequence
  Synthetically generated peptide
AACCEFCCTPACTGC

SEQ ID NO: 2123 - protein, 16 aa, Artificial Sequence
  Synthetically generated peptide
AACCEFCCTPACTGCK

SEQ ID NO: 2124 - protein, 16 aa, Artificial Sequence
  Synthetically generated peptide
AACCEFCCTPACTGCY

SEQ ID NO: 2125 - protein, 15 aa, Artificial Sequence
  Synthetically generated peptide
  misc_feature (15)..(15): Xaa can be Cys or D-Cys
AACCEFCCTPACTGX

SEQ ID NO: 2126 - protein, 16 aa, Artificial Sequence
  Synthetically generated peptide
  misc_feature (15)..(15): Xaa can be Cys or D-Cys
AACCEFCCTPACTGXK

SEQ ID NO: 2127 - protein, 16 aa, Artificial Sequence
  Synthetically generated peptide
  misc_feature (15)..(15): Xaa can be Cys or D-Cys
AACCEFCCTPACTGXY

SEQ ID NO: 2128 - protein, 15 aa, Artificial Sequence
  Synthetically generated peptide
  misc_feature (7)..(7): Xaa can be Cys or D-Cys
AACCEFXCNPACTGC

SEQ ID NO: 2129 - protein, 16 aa, Artificial Sequence
  Synthetically generated peptide
  misc_feature (7)..(7): Xaa can be Cys or D-Cys
AACCEFXCNPACTGCK

SEQ ID NO: 2130 - protein, 16 aa, Artificial Sequence
  Synthetically generated peptide
  misc_feature (7)..(7): Xaa can be Cys or D-Cys
AACCEFXCNPACTGCY

SEQ ID NO: 2131 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AACCEFXCNPACTGX

SEQ ID NO: 2132 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AACCEFXCNPACTGXK

SEQ ID NO: 2133 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AACCEFXCNPACTGXY

SEQ ID NO: 2134 - protein, 15 aa, Artificial Sequence
  Synthetically generated peptide
  misc_feature (7)..(7): Xaa can be Cys or D-Cys
AACCEFXCTPACTGC

SEQ ID NO: 2135 - protein, 16 aa, Artificial Sequence
  Synthetically generated peptide
  misc_feature (7)..(7): Xaa can be Cys or D-Cys
AACCEFXCTPACTGCK

SEQ ID NO: 2136 - protein, 16 aa, Artificial Sequence
  Synthetically generated peptide
  misc_feature (7)..(7): Xaa can be Cys or D-Cys
AACCEFXCTPACTGCY

SEQ ID NO: 2137 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AACCEFXCTPACTGX

SEQ ID NO: 2138 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AACCEFXCTPACTGXK

SEQ ID NO: 2139 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AACCEFXCTPACTGXY

SEQ ID NO: 2140 - protein, 15 aa, Artificial Sequence
  Synthetically generated peptide
AACCEWCCNPACTGC

SEQ ID NO: 2141 - protein, 16 aa, Artificial Sequence
  Synthetically generated peptide
AACCEWCCNPACTGCK

SEQ ID NO: 2142 - protein, 16 aa, Artificial Sequence
  Synthetically generated peptide
AACCEWCCNPACTGCY

SEQ ID NO: 2143 - protein, 15 aa, Artificial Sequence
  Synthetically generated peptide
  misc_feature (15)..(15): Xaa can be Cys or D-Cys
AACCEWCCNPACTGX

SEQ ID NO: 2144 - protein, 16 aa, Artificial Sequence
  Synthetically generated peptide
  misc_feature (15)..(15): Xaa can be Cys or D-Cys
AACCEWCCNPACTGXK

SEQ ID NO: 2145 - protein, 16 aa, Artificial Sequence
  Synthetically generated peptide
  misc_feature (15)..(15): Xaa can be Cys or D-Cys
AACCEWCCNPACTGXY

SEQ ID NO: 2146 - protein, 15 aa, Artificial Sequence
  Synthetically generated peptide
AACCEWCCTPACTGC

SEQ ID NO: 2147 - protein, 16 aa, Artificial Sequence
  Synthetically generated peptide
AACCEWCCTPACTGCK

SEQ ID NO: 2148 - protein, 16 aa, Artificial Sequence
  Synthetically generated peptide
AACCEWCCTPACTGCY

SEQ ID NO: 2149 - protein, 15 aa, Artificial Sequence
  Synthetically generated peptide
  misc_feature (15)..(15): Xaa can be Cys or D-Cys
AACCEWCCTPACTGX

SEQ ID NO: 2150 - protein, 16 aa, Artificial Sequence
  Synthetically generated peptide
  misc_feature (15)..(15): Xaa can be Cys or D-Cys
AACCEWCCTPACTGXK

SEQ ID NO: 2151 - protein, 16 aa, Artificial Sequence
  Synthetically generated peptide
  misc_feature (15)..(15): Xaa can be Cys or D-Cys
AACCEWCCTPACTGXY

SEQ ID NO: 2152 - protein, 15 aa, Artificial Sequence
  Synthetically generated peptide
  misc_feature (7)..(7): Xaa can be Cys or D-Cys
AACCEWXCNPACTGC

SEQ ID NO: 2153 - protein, 16 aa, Artificial Sequence
  Synthetically generated peptide
  misc_feature (7)..(7): Xaa can be Cys or D-Cys
AACCEWXCNPACTGCK

SEQ ID NO: 2154 - protein, 16 aa, Artificial Sequence
  Synthetically generated peptide
  misc_feature (7)..(7): Xaa can be Cys or D-Cys
AACCEWXCNPACTGCY

SEQ ID NO: 2155 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AACCEWXCNPACTGX

SEQ ID NO: 2156 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AACCEWXCNPACTGXK

SEQ ID NO: 2157 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AACCEWXCNPACTGXY

SEQ ID NO: 2158 - protein, 15 aa, Artificial Sequence
  Synthetically generated peptide
  misc_feature (7)..(7): Xaa can be Cys or D-Cys
AACCEWXCTPACTGC

SEQ ID NO: 2159 - protein, 16 aa, Artificial Sequence
  Synthetically generated peptide
  misc_feature (7)..(7): Xaa can be Cys or D-Cys
AACCEWXCTPACTGCK

SEQ ID NO: 2160 - protein, 16 aa, Artificial Sequence
  Synthetically generated peptide
  misc_feature (7)..(7): Xaa can be Cys or D-Cys
AACCEWXCTPACTGCY

SEQ ID NO: 2161 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AACCEWXCTPACTGX

SEQ ID NO: 2162 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AACCEWXCTPACTGXK

SEQ ID NO: 2163 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AACCEWXCTPACTGXY

SEQ ID NO: 2164 - protein, 15 aa, Artificial Sequence
  Synthetically generated peptide
  misc_feature (3)..(3): Xaa can be Cys or D-Cys
AAXCEVCCNPACTGC

SEQ ID NO: 2165 - protein, 16 aa, Artificial Sequence
  Synthetically generated peptide
  misc_feature (3)..(3): Xaa can be Cys or D-Cys
AAXCEVCCNPACTGCK

SEQ ID NO: 2166 - protein, 16 aa, Artificial Sequence
  Synthetically generated peptide
  misc_feature (3)..(3): Xaa can be Cys or D-Cys
AAXCEVCCNPACTGCY

SEQ ID NO: 2167 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AAXCEVCCNPACTGX

SEQ ID NO: 2168 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AAXCEVCCNPACTGXK

SEQ ID NO: 2169 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AAXCEVCCNPACTGXY

SEQ ID NO: 2170 - protein, 15 aa, Artificial Sequence
  Synthetically generated peptide
  misc_feature (3)..(3): Xaa can be Cys or D-Cys
AAXCEVCCTPACTGC

SEQ ID NO: 2171 - protein, 16 aa, Artificial Sequence
  Synthetically generated peptide
  misc_feature (3)..(3): Xaa can be Cys or D-Cys
AAXCEVCCTPACTGCK

SEQ ID NO: 2172 - protein, 16 aa, Artificial Sequence
  Synthetically generated peptide
  misc_feature (3)..(3): Xaa can be Cys or D-Cys
AAXCEVCCTPACTGCY

SEQ ID NO: 2173 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AAXCEVCCTPACTGX

SEQ ID NO: 2174 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AAXCEVCCTPACTGXK

SEQ ID NO: 2175 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AAXCEVCCTPACTGXY

SEQ ID NO: 2176 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AAXCEVXCNPACTGC

SEQ ID NO: 2177 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AAXCEVXCNPACTGCK

SEQ ID NO: 2178 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AAXCEVXCNPACTGCY

SEQ ID NO: 2179 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCEVXCNPACTGX

SEQ ID NO: 2180 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCEVXCNPACTGXK

SEQ ID NO: 2181 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCEVXCNPACTGXY

SEQ ID NO: 2182 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AAXCEVXCTPACTGC

SEQ ID NO: 2183 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AAXCEVXCTPACTGCK

SEQ ID NO: 2184 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AAXCEVXCTPACTGCY

SEQ ID NO: 2185 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCEVXCTPACTGX

SEQ ID NO: 2186 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCEVXCTPACTGXK

SEQ ID NO: 2187 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCEVXCTPACTGXY

SEQ ID NO: 2188 - protein, 15 aa, Artificial Sequence
  Synthetically generated peptide
  misc_feature (3)..(3): Xaa can be Cys or D-Cys
AAXCEICCNPACTGC

SEQ ID NO: 2189 - protein, 16 aa, Artificial Sequence
  Synthetically generated peptide
  misc_feature (3)..(3): Xaa can be Cys or D-Cys
AAXCEICCNPACTGCK

SEQ ID NO: 2190 - protein, 16 aa, Artificial Sequence
  Synthetically generated peptide
  misc_feature (3)..(3): Xaa can be Cys or D-Cys
AAXCEICCNPACTGCY

SEQ ID NO: 2191 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AAXCEICCNPACTGX

SEQ ID NO: 2192 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AAXCEICCNPACTGXK

SEQ ID NO: 2193 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AAXCEICCNPACTGXY

SEQ ID NO: 2194 - protein, 15 aa, Artificial Sequence
  Synthetically generated peptide
  misc_feature (3)..(3): Xaa can be Cys or D-Cys
AAXCEICCTPACTGC

SEQ ID NO: 2195 - protein, 16 aa, Artificial Sequence
  Synthetically generated peptide
  misc_feature (3)..(3): Xaa can be Cys or D-Cys
AAXCEICCTPACTGCK

SEQ ID NO: 2196 - protein, 16 aa, Artificial Sequence
  Synthetically generated peptide
  misc_feature (3)..(3): Xaa can be Cys or D-Cys
AAXCEICCTPACTGCY

SEQ ID NO: 2197 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AAXCEICCTPACTGX

SEQ ID NO: 2198 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AAXCEICCTPACTGXK

SEQ ID NO: 2199 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AAXCEICCTPACTGXY

SEQ ID NO: 2200 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AAXCEIXCNPACTGC

SEQ ID NO: 2201 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AAXCEIXCNPACTGCK

SEQ ID NO: 2202 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AAXCEIXCNPACTGCY

SEQ ID NO: 2203 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCEIXCNPACTGX

SEQ ID NO: 2204 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCEIXCNPACTGXK

SEQ ID NO: 2205 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCEIXCNPACTGXY

SEQ ID NO: 2206 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AAXCEIXCTPACTGC

SEQ ID NO: 2207 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AAXCEIXCTPACTGCK

SEQ ID NO: 2208 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AAXCEIXCTPACTGCY

SEQ ID NO: 2209 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCEIXCTPACTGX

SEQ ID NO: 2210 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCEIXCTPACTGXK

SEQ ID NO: 2211 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCEIXCTPACTGXY

SEQ ID NO: 2212 - protein, 15 aa, Artificial Sequence
  Synthetically generated peptide
  misc_feature (3)..(3): Xaa can be Cys or D-Cys
AAXCELCCNPACTGC

SEQ ID NO: 2213 - protein, 16 aa, Artificial Sequence
  Synthetically generated peptide
  misc_feature (3)..(3): Xaa can be Cys or D-Cys
AAXCELCCNPACTGCK

SEQ ID NO: 2214 - protein, 16 aa, Artificial Sequence
  Synthetically generated peptide
  misc_feature (3)..(3): Xaa can be Cys or D-Cys
AAXCELCCNPACTGCY

SEQ ID NO: 2215 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AAXCELCCNPACTGX

SEQ ID NO: 2216 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AAXCELCCNPACTGXK

SEQ ID NO: 2217 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AAXCELCCNPACTGXY

SEQ ID NO: 2218 - protein, 15 aa, Artificial Sequence
  Synthetically generated peptide
  misc_feature (3)..(3): Xaa can be Cys or D-Cys
AAXCELCCTPACTGC

SEQ ID NO: 2219 - protein, 16 aa, Artificial Sequence
  Synthetically generated peptide
  misc_feature (3)..(3): Xaa can be Cys or D-Cys
AAXCELCCTPACTGCK

SEQ ID NO: 2220 - protein, 16 aa, Artificial Sequence
  Synthetically generated peptide
  misc_feature (3)..(3): Xaa can be Cys or D-Cys
AAXCELCCTPACTGCY

SEQ ID NO: 2221 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AAXCELCCTPACTGX

SEQ ID NO: 2222 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AAXCELCCTPACTGXK

SEQ ID NO: 2223 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AAXCELCCTPACTGXY

SEQ ID NO: 2224 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AAXCELXCNPACTGC

SEQ ID NO: 2225 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AAXCELXCNPACTGCK

SEQ ID NO: 2226 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AAXCELXCNPACTGCY

SEQ ID NO: 2227 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCELXCNPACTGX

SEQ ID NO: 2228 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCELXCNPACTGXK

SEQ ID NO: 2229 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCELXCNPACTGXY

SEQ ID NO: 2230 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AAXCELXCTPACTGC

SEQ ID NO: 2231 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AAXCELXCTPACTGCK

SEQ ID NO: 2232 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AAXCELXCTPACTGCY

SEQ ID NO: 2233 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCELXCTPACTGX

SEQ ID NO: 2234 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCELXCTPACTGXK

SEQ ID NO: 2235 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCELXCTPACTGXY

SEQ ID NO: 2236 - protein, 15 aa, Artificial Sequence
  Synthetically generated peptide
  misc_feature (3)..(3): Xaa can be Cys or D-Cys
AAXCEYCCNPACTGC

SEQ ID NO: 2237 - protein, 16 aa, Artificial Sequence
  Synthetically generated peptide
  misc_feature (3)..(3): Xaa can be Cys or D-Cys
AAXCEYCCNPACTGCK

SEQ ID NO: 2238 - protein, 16 aa, Artificial Sequence
  Synthetically generated peptide
  misc_feature (3)..(3): Xaa can be Cys or D-Cys
AAXCEYCCNPACTGCY

SEQ ID NO: 2239 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AAXCEYCCNPACTGX

SEQ ID NO: 2240 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AAXCEYCCNPACTGXK

SEQ ID NO: 2241 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AAXCEYCCNPACTGXY

SEQ ID NO: 2242 - protein, 15 aa, Artificial Sequence
  Synthetically generated peptide
  misc_feature (3)..(3): Xaa can be Cys or D-Cys
AAXCEYCCTPACTGC

SEQ ID NO: 2243 - protein, 16 aa, Artificial Sequence
  Synthetically generated peptide
  misc_feature (3)..(3): Xaa can be Cys or D-Cys
AAXCEYCCTPACTGCK

SEQ ID NO: 2244 - protein, 16 aa, Artificial Sequence
  Synthetically generated peptide
  misc_feature (3)..(3): Xaa can be Cys or D-Cys
AAXCEYCCTPACTGCY

SEQ ID NO: 2245 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AAXCEYCCTPACTGX

SEQ ID NO: 2246 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AAXCEYCCTPACTGXK

SEQ ID NO: 2247 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AAXCEYCCTPACTGXY

SEQ ID NO: 2248 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AAXCEYXCNPACTGC

SEQ ID NO: 2249 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AAXCEYXCNPACTGCK

SEQ ID NO: 2250 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AAXCEYXCNPACTGCY

SEQ ID NO: 2251 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCEYXCNPACTGX

SEQ ID NO: 2252 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCEYXCNPACTGXK

SEQ ID NO: 2253 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCEYXCNPACTGXY

SEQ ID NO: 2254 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AAXCEYXCTPACTGC

SEQ ID NO: 2255 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AAXCEYXCTPACTGCK

SEQ ID NO: 2256 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AAXCEYXCTPACTGCY

SEQ ID NO: 2257 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCEYXCTPACTGX

SEQ ID NO: 2258 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCEYXCTPACTGXK

SEQ ID NO: 2259 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCEYXCTPACTGXY

SEQ ID NO: 2260 - protein, 15 aa, Artificial Sequence
  Synthetically generated peptide
  misc_feature (3)..(3): Xaa can be Cys or D-Cys
AAXCEFCCNPACTGC

SEQ ID NO: 2261 - protein, 16 aa, Artificial Sequence
  Synthetically generated peptide
  misc_feature (3)..(3): Xaa can be Cys or D-Cys
AAXCEFCCNPACTGCK

SEQ ID NO: 2262 - protein, 16 aa, Artificial Sequence
  Synthetically generated peptide
  misc_feature (3)..(3): Xaa can be Cys or D-Cys
AAXCEFCCNPACTGCY

SEQ ID NO: 2263 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AAXCEFCCNPACTGX

SEQ ID NO: 2264 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AAXCEFCCNPACTGXK

SEQ ID NO: 2265 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AAXCEFCCNPACTGXY

SEQ ID NO: 2266 - protein, 15 aa, Artificial Sequence
  Synthetically generated peptide
  misc_feature (3)..(3): Xaa can be Cys or D-Cys
AAXCEFCCTPACTGC

SEQ ID NO: 2267 - protein, 16 aa, Artificial Sequence
  Synthetically generated peptide
  misc_feature (3)..(3): Xaa can be Cys or D-Cys
AAXCEFCCTPACTGCK

SEQ ID NO: 2268 - protein, 16 aa, Artificial Sequence
  Synthetically generated peptide
  misc_feature (3)..(3): Xaa can be Cys or D-Cys
AAXCEFCCTPACTGCY

SEQ ID NO: 2269 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AAXCEFCCTPACTGX

SEQ ID NO: 2270 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AAXCEFCCTPACTGXK

SEQ ID NO: 2271 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AAXCEFCCTPACTGXY

SEQ ID NO: 2272 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AAXCEFXCNPACTGC

SEQ ID NO: 2273 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AAXCEFXCNPACTGCK

SEQ ID NO: 2274 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AAXCEFXCNPACTGCY

SEQ ID NO: 2275 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCEFXCNPACTGX

SEQ ID NO: 2276 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCEFXCNPACTGXK

SEQ ID NO: 2277 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCEFXCNPACTGXY

SEQ ID NO: 2278 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AAXCEFXCTPACTGC

SEQ ID NO: 2279 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AAXCEFXCTPACTGCK

SEQ ID NO: 2280 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AAXCEFXCTPACTGCY

SEQ ID NO: 2281 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCEFXCTPACTGX

SEQ ID NO: 2282 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCEFXCTPACTGXK

SEQ ID NO: 2283 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCEFXCTPACTGXY

SEQ ID NO: 2284 - protein, 15 aa, Artificial Sequence
  Synthetically generated peptide
  misc_feature (3)..(3): Xaa can be Cys or D-Cys
AAXCEWCCNPACTGC

SEQ ID NO: 2285 - protein, 16 aa, Artificial Sequence
  Synthetically generated peptide
  misc_feature (3)..(3): Xaa can be Cys or D-Cys
AAXCEWCCNPACTGCK

SEQ ID NO: 2286 - protein, 16 aa, Artificial Sequence
  Synthetically generated peptide
  misc_feature (3)..(3): Xaa can be Cys or D-Cys
AAXCEWCCNPACTGCY

SEQ ID NO: 2287 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AAXCEWCCNPACTGX

SEQ ID NO: 2288 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AAXCEWCCNPACTGXK

SEQ ID NO: 2289 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AAXCEWCCNPACTGXY

SEQ ID NO: 2290 - protein, 15 aa, Artificial Sequence
  Synthetically generated peptide
  misc_feature (3)..(3): Xaa can be Cys or D-Cys
AAXCEWCCTPACTGC

SEQ ID NO: 2291 - protein, 16 aa, Artificial Sequence
  Synthetically generated peptide
  misc_feature (3)..(3): Xaa can be Cys or D-Cys
AAXCEWCCTPACTGCK

SEQ ID NO: 2292 - protein, 16 aa, Artificial Sequence
  Synthetically generated peptide
  misc_feature (3)..(3): Xaa can be Cys or D-Cys
AAXCEWCCTPACTGCY

SEQ ID NO: 2293 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AAXCEWCCTPACTGX

SEQ ID NO: 2294 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AAXCEWCCTPACTGXK

SEQ ID NO: 2295 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AAXCEWCCTPACTGXY

SEQ ID NO: 2296 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AAXCEWXCNPACTGC

SEQ ID NO: 2297 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AAXCEWXCNPACTGCK

SEQ ID NO: 2298 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AAXCEWXCNPACTGCY

SEQ ID NO: 2299 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCEWXCNPACTGX

SEQ ID NO: 2300 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCEWXCNPACTGXK

SEQ ID NO: 2301 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCEWXCNPACTGXY

SEQ ID NO: 2302 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AAXCEWXCTPACTGC

SEQ ID NO: 2303 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AAXCEWXCTPACTGCK

SEQ ID NO: 2304 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AAXCEWXCTPACTGCY

SEQ ID NO: 2305 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCEWXCTPACTGX

SEQ ID NO: 2306 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCEWXCTPACTGXK

SEQ ID NO: 2307 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AAXCEWXCTPACTGXY

SEQ ID NO: 2308 - protein, 15 aa, Artificial Sequence
  Synthetically generated peptide
AGCCEVCCNPACTGC

SEQ ID NO: 2309 - protein, 16 aa, Artificial Sequence
  Synthetically generated peptide
AGCCEVCCNPACTGCK

SEQ ID NO: 2310 - protein, 16 aa, Artificial Sequence
  Synthetically generated peptide
AGCCEVCCNPACTGCY

SEQ ID NO: 2311 - protein, 15 aa, Artificial Sequence
  Synthetically generated peptide
  misc_feature (15)..(15): Xaa can be Cys or D-Cys
AGCCEVCCNPACTGX

SEQ ID NO: 2312 - protein, 16 aa, Artificial Sequence
  Synthetically generated peptide
  misc_feature (15)..(15): Xaa can be Cys or D-Cys
AGCCEVCCNPACTGXK

SEQ ID NO: 2313 - protein, 16 aa, Artificial Sequence
  Synthetically generated peptide
  misc_feature (15)..(15): Xaa can be Cys or D-Cys
AGCCEVCCNPACTGXY

SEQ ID NO: 2314 - protein, 15 aa, Artificial Sequence
  Synthetically generated peptide
AGCCEVCCTPACTGC

SEQ ID NO: 2315 - protein, 16 aa, Artificial Sequence
  Synthetically generated peptide
AGCCEVCCTPACTGCK

SEQ ID NO: 2316 - protein, 16 aa, Artificial Sequence
  Synthetically generated peptide
AGCCEVCCTPACTGCY

SEQ ID NO: 2317 - protein, 15 aa, Artificial Sequence
  Synthetically generated peptide
  misc_feature (15)..(15): Xaa can be Cys or D-Cys
AGCCEVCCTPACTGX

SEQ ID NO: 2318 - protein, 16 aa, Artificial Sequence
  Synthetically generated peptide
  misc_feature (15)..(15): Xaa can be Cys or D-Cys
AGCCEVCCTPACTGXK

SEQ ID NO: 2319 - protein, 16 aa, Artificial Sequence
  Synthetically generated peptide
  misc_feature (15)..(15): Xaa can be Cys or D-Cys
AGCCEVCCTPACTGXY

SEQ ID NO: 2320 - protein, 15 aa, Artificial Sequence
  Synthetically generated peptide
  misc_feature (7)..(7): Xaa can be Cys or D-Cys
AGCCEVXCNPACTGC

SEQ ID NO: 2321 - protein, 16 aa, Artificial Sequence
  Synthetically generated peptide
  misc_feature (7)..(7): Xaa can be Cys or D-Cys
AGCCEVXCNPACTGCK

SEQ ID NO: 2322 - protein, 16 aa, Artificial Sequence
  Synthetically generated peptide
  misc_feature (7)..(7): Xaa can be Cys or D-Cys
AGCCEVXCNPACTGCY

SEQ ID NO: 2323 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AGCCEVXCNPACTGX

SEQ ID NO: 2324 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AGCCEVXCNPACTGXK

SEQ ID NO: 2325 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AGCCEVXCNPACTGXY

SEQ ID NO: 2326 - protein, 15 aa, Artificial Sequence
  Synthetically generated peptide
  misc_feature (7)..(7): Xaa can be Cys or D-Cys
AGCCEVXCTPACTGC

SEQ ID NO: 2327 - protein, 16 aa, Artificial Sequence
  Synthetically generated peptide
  misc_feature (7)..(7): Xaa can be Cys or D-Cys
AGCCEVXCTPACTGCK

SEQ ID NO: 2328 - protein, 16 aa, Artificial Sequence
  Synthetically generated peptide
  misc_feature (7)..(7): Xaa can be Cys or D-Cys
AGCCEVXCTPACTGCY

SEQ ID NO: 2329 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AGCCEVXCTPACTGX

SEQ ID NO: 2330 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AGCCEVXCTPACTGXK

SEQ ID NO: 2331 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AGCCEVXCTPACTGXY

SEQ ID NO: 2332 - protein, 15 aa, Artificial Sequence
  Synthetically generated peptide
AGCCEICCNPACTGC

SEQ ID NO: 2333 - protein, 16 aa, Artificial Sequence
  Synthetically generated peptide
AGCCEICCNPACTGCK

SEQ ID NO: 2334 - protein, 16 aa, Artificial Sequence
  Synthetically generated peptide
AGCCEICCNPACTGCY

SEQ ID NO: 2335 - protein, 15 aa, Artificial Sequence
  Synthetically generated peptide
  misc_feature (15)..(15): Xaa can be Cys or D-Cys
AGCCEICCNPACTGX

SEQ ID NO: 2336 - protein, 16 aa, Artificial Sequence
  Synthetically generated peptide
  misc_feature (15)..(15): Xaa can be Cys or D-Cys
AGCCEICCNPACTGXK

SEQ ID NO: 2337 - protein, 16 aa, Artificial Sequence
  Synthetically generated peptide
  misc_feature (15)..(15): Xaa can be Cys or D-Cys
AGCCEICCNPACTGXY

SEQ ID NO: 2338 - protein, 15 aa, Artificial Sequence
  Synthetically generated peptide
AGCCEICCTPACTGC

SEQ ID NO: 2339 - protein, 16 aa, Artificial Sequence
  Synthetically generated peptide
AGCCEICCTPACTGCK

SEQ ID NO: 2340 - protein, 16 aa, Artificial Sequence
  Synthetically generated peptide
AGCCEICCTPACTGCY

SEQ ID NO: 2341 - protein, 15 aa, Artificial Sequence
  Synthetically generated peptide
  misc_feature (15)..(15): Xaa can be Cys or D-Cys
AGCCEICCTPACTGX

SEQ ID NO: 2342 - protein, 16 aa, Artificial Sequence
  Synthetically generated peptide
  misc_feature (15)..(15): Xaa can be Cys or D-Cys
AGCCEICCTPACTGXK

SEQ ID NO: 2343 - protein, 16 aa, Artificial Sequence
  Synthetically generated peptide
  misc_feature (15)..(15): Xaa can be Cys or D-Cys
AGCCEICCTPACTGXY

SEQ ID NO: 2344 - protein, 15 aa, Artificial Sequence
  Synthetically generated peptide
  misc_feature (7)..(7): Xaa can be Cys or D-Cys
AGCCEIXCNPACTGC

SEQ ID NO: 2345 - protein, 16 aa, Artificial Sequence
  Synthetically generated peptide
  misc_feature (7)..(7): Xaa can be Cys or D-Cys
AGCCEIXCNPACTGCK

SEQ ID NO: 2346 - protein, 16 aa, Artificial Sequence
  Synthetically generated peptide
  misc_feature (7)..(7): Xaa can be Cys or D-Cys
AGCCEIXCNPACTGCY

SEQ ID NO: 2347 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AGCCEIXCNPACTGX

SEQ ID NO: 2348 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AGCCEIXCNPACTGXK

SEQ ID NO: 2349 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AGCCEIXCNPACTGXY

SEQ ID NO: 2350 - protein, 15 aa, Artificial Sequence
  Synthetically generated peptide
  misc_feature (7)..(7): Xaa can be Cys or D-Cys
AGCCEIXCTPACTGC

SEQ ID NO: 2351 - protein, 16 aa, Artificial Sequence
  Synthetically generated peptide
  misc_feature (7)..(7): Xaa can be Cys or D-Cys
AGCCEIXCTPACTGCK

SEQ ID NO: 2352 - protein, 16 aa, Artificial Sequence
  Synthetically generated peptide
  misc_feature (7)..(7): Xaa can be Cys or D-Cys
AGCCEIXCTPACTGCY

SEQ ID NO: 2353 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AGCCEIXCTPACTGX

SEQ ID NO: 2354 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AGCCEIXCTPACTGXK

SEQ ID NO: 2355 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AGCCEIXCTPACTGXY

SEQ ID NO: 2356 - protein, 15 aa, Artificial Sequence
  Synthetically generated peptide
AGCCELCCNPACTGC

SEQ ID NO: 2357 - protein, 16 aa, Artificial Sequence
  Synthetically generated peptide
AGCCELCCNPACTGCK

SEQ ID NO: 2358 - protein, 16 aa, Artificial Sequence
  Synthetically generated peptide
AGCCELCCNPACTGCY

SEQ ID NO: 2359 - protein, 15 aa, Artificial Sequence
  Synthetically generated peptide
  misc_feature (15)..(15): Xaa can be Cys or D-Cys
AGCCELCCNPACTGX

SEQ ID NO: 2360 - protein, 16 aa, Artificial Sequence
  Synthetically generated peptide
  misc_feature (15)..(15): Xaa can be Cys or D-Cys
AGCCELCCNPACTGXK

SEQ ID NO: 2361 - protein, 16 aa, Artificial Sequence
  Synthetically generated peptide
  misc_feature (15)..(15): Xaa can be Cys or D-Cys
AGCCELCCNPACTGXY

SEQ ID NO: 2362 - protein, 15 aa, Artificial Sequence
  Synthetically generated peptide
AGCCELCCTPACTGC

SEQ ID NO: 2363 - protein, 16 aa, Artificial Sequence
  Synthetically generated peptide
AGCCELCCTPACTGCK

SEQ ID NO: 2364 - protein, 16 aa, Artificial Sequence
  Synthetically generated peptide
AGCCELCCTPACTGCY

SEQ ID NO: 2365 - protein, 15 aa, Artificial Sequence
  Synthetically generated peptide
  misc_feature (15)..(15): Xaa can be Cys or D-Cys
AGCCELCCTPACTGX

SEQ ID NO: 2366 - protein, 16 aa, Artificial Sequence
  Synthetically generated peptide
  misc_feature (15)..(15): Xaa can be Cys or D-Cys
AGCCELCCTPACTGXK

SEQ ID NO: 2367 - protein, 16 aa, Artificial Sequence
  Synthetically generated peptide
  misc_feature (15)..(15): Xaa can be Cys or D-Cys
AGCCELCCTPACTGXY

SEQ ID NO: 2368 - protein, 15 aa, Artificial Sequence
  Synthetically generated peptide
  misc_feature (7)..(7): Xaa can be Cys or D-Cys
AGCCELXCNPACTGC

SEQ ID NO: 2369 - protein, 16 aa, Artificial Sequence
  Synthetically generated peptide
  misc_feature (7)..(7): Xaa can be Cys or D-Cys
AGCCELXCNPACTGCK

SEQ ID NO: 2370 - protein, 16 aa, Artificial Sequence
  Synthetically generated peptide
  misc_feature (7)..(7): Xaa can be Cys or D-Cys
AGCCELXCNPACTGCY

SEQ ID NO: 2371 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AGCCELXCNPACTGX

SEQ ID NO: 2372 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AGCCELXCNPACTGXK

SEQ ID NO: 2373 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AGCCELXCNPACTGXY

SEQ ID NO: 2374 - protein, 15 aa, Artificial Sequence
  Synthetically generated peptide
  misc_feature (7)..(7): Xaa can be Cys or D-Cys
AGCCELXCTPACTGC

SEQ ID NO: 2375 - protein, 16 aa, Artificial Sequence
  Synthetically generated peptide
  misc_feature (7)..(7): Xaa can be Cys or D-Cys
AGCCELXCTPACTGCK

SEQ ID NO: 2376 - protein, 16 aa, Artificial Sequence
  Synthetically generated peptide
  misc_feature (7)..(7): Xaa can be Cys or D-Cys
AGCCELXCTPACTGCY

SEQ ID NO: 2377 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AGCCELXCTPACTGX

SEQ ID NO: 2378 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AGCCELXCTPACTGXK

SEQ ID NO: 2379 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AGCCELXCTPACTGXY

SEQ ID NO: 2380 - protein, 15 aa, Artificial Sequence
  Synthetically generated peptide
AGCCEYCCNPACTGC

SEQ ID NO: 2381 - protein, 16 aa, Artificial Sequence
  Synthetically generated peptide
AGCCEYCCNPACTGCK

SEQ ID NO: 2382 - protein, 16 aa, Artificial Sequence
  Synthetically generated peptide
AGCCEYCCNPACTGCY

SEQ ID NO: 2383 - protein, 15 aa, Artificial Sequence
  Synthetically generated peptide
  misc_feature (15)..(15): Xaa can be Cys or D-Cys
AGCCEYCCNPACTGX

SEQ ID NO: 2384 - protein, 16 aa, Artificial Sequence
  Synthetically generated peptide
  misc_feature (15)..(15): Xaa can be Cys or D-Cys
AGCCEYCCNPACTGXK

SEQ ID NO: 2385 - protein, 16 aa, Artificial Sequence
  Synthetically generated peptide
  misc_feature (15)..(15): Xaa can be Cys or D-Cys
AGCCEYCCNPACTGXY

SEQ ID NO: 2386 - protein, 15 aa, Artificial Sequence
  Synthetically generated peptide
AGCCEYCCTPACTGC

SEQ ID NO: 2387 - protein, 16 aa, Artificial Sequence
  Synthetically generated peptide
AGCCEYCCTPACTGCK

SEQ ID NO: 2388 - protein, 16 aa, Artificial Sequence
  Synthetically generated peptide
AGCCEYCCTPACTGCY

SEQ ID NO: 2389 - protein, 15 aa, Artificial Sequence
  Synthetically generated peptide
  misc_feature (15)..(15): Xaa can be Cys or D-Cys
AGCCEYCCTPACTGX

SEQ ID NO: 2390 - protein, 16 aa, Artificial Sequence
  Synthetically generated peptide
  misc_feature (15)..(15): Xaa can be Cys or D-Cys
AGCCEYCCTPACTGXK

SEQ ID NO: 2391 - protein, 16 aa, Artificial Sequence
  Synthetically generated peptide
  misc_feature (15)..(15): Xaa can be Cys or D-Cys
AGCCEYCCTPACTGXY

SEQ ID NO: 2392 - protein, 15 aa, Artificial Sequence
  Synthetically generated peptide
  misc_feature (7)..(7): Xaa can be Cys or D-Cys
AGCCEYXCNPACTGC

SEQ ID NO: 2393 - protein, 16 aa, Artificial Sequence
  Synthetically generated peptide
  misc_feature (7)..(7): Xaa can be Cys or D-Cys
AGCCEYXCNPACTGCK

SEQ ID NO: 2394 - protein, 16 aa, Artificial Sequence
  Synthetically generated peptide
  misc_feature (7)..(7): Xaa can be Cys or D-Cys
AGCCEYXCNPACTGCY

SEQ ID NO: 2395 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AGCCEYXCNPACTGX

SEQ ID NO: 2396 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AGCCEYXCNPACTGXK

SEQ ID NO: 2397 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AGCCEYXCNPACTGXY

SEQ ID NO: 2398 - protein, 15 aa, Artificial Sequence
  Synthetically generated peptide
  misc_feature (7)..(7): Xaa can be Cys or D-Cys
AGCCEYXCTPACTGC

SEQ ID NO: 2399 - protein, 16 aa, Artificial Sequence
  Synthetically generated peptide
  misc_feature (7)..(7): Xaa can be Cys or D-Cys
AGCCEYXCTPACTGCK

SEQ ID NO: 2400 - protein, 16 aa, Artificial Sequence
  Synthetically generated peptide
  misc_feature (7)..(7): Xaa can be Cys or D-Cys
AGCCEYXCTPACTGCY

SEQ ID NO: 2401 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AGCCEYXCTPACTGX

SEQ ID NO: 2402 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AGCCEYXCTPACTGXK

SEQ ID NO: 2403 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AGCCEYXCTPACTGXY

SEQ ID NO: 2404 - protein, 15 aa, Artificial Sequence
  Synthetically generated peptide
AGCCEFCCNPACTGC

SEQ ID NO: 2405 - protein, 16 aa, Artificial Sequence
  Synthetically generated peptide
AGCCEFCCNPACTGCK

SEQ ID NO: 2406 - protein, 16 aa, Artificial Sequence
  Synthetically generated peptide
AGCCEFCCNPACTGCY

SEQ ID NO: 2407 - protein, 15 aa, Artificial Sequence
  Synthetically generated peptide
  misc_feature (15)..(15): Xaa can be Cys or D-Cys
AGCCEFCCNPACTGX

SEQ ID NO: 2408 - protein, 16 aa, Artificial Sequence
  Synthetically generated peptide
  misc_feature (15)..(15): Xaa can be Cys or D-Cys
AGCCEFCCNPACTGXK

SEQ ID NO: 2409 - protein, 16 aa, Artificial Sequence
  Synthetically generated peptide
  misc_feature (15)..(15): Xaa can be Cys or D-Cys
AGCCEFCCNPACTGXY

SEQ ID NO: 2410 - protein, 15 aa, Artificial Sequence
  Synthetically generated peptide
AGCCEFCCTPACTGC

SEQ ID NO: 2411 - protein, 16 aa, Artificial Sequence
  Synthetically generated peptide
AGCCEFCCTPACTGCK

SEQ ID NO: 2412 - protein, 16 aa, Artificial Sequence
  Synthetically generated peptide
AGCCEFCCTPACTGCY

SEQ ID NO: 2413 - protein, 15 aa, Artificial Sequence
  Synthetically generated peptide
  misc_feature (15)..(15): Xaa can be Cys or D-Cys
AGCCEFCCTPACTGX

SEQ ID NO: 2414 - protein, 16 aa, Artificial Sequence
  Synthetically generated peptide
  misc_feature (15)..(15): Xaa can be Cys or D-Cys
AGCCEFCCTPACTGXK

SEQ ID NO: 2415 - protein, 16 aa, Artificial Sequence
  Synthetically generated peptide
  misc_feature (15)..(15): Xaa can be Cys or D-Cys
AGCCEFCCTPACTGXY

SEQ ID NO: 2416 - protein, 15 aa, Artificial Sequence
  Synthetically generated peptide
  misc_feature (7)..(7): Xaa can be Cys or D-Cys
AGCCEFXCNPACTGC

SEQ ID NO: 2417 - protein, 16 aa, Artificial Sequence
  Synthetically generated peptide
  misc_feature (7)..(7): Xaa can be Cys or D-Cys
AGCCEFXCNPACTGCK

SEQ ID NO: 2418 - protein, 16 aa, Artificial Sequence
  Synthetically generated peptide
  misc_feature (7)..(7): Xaa can be Cys or D-Cys
AGCCEFXCNPACTGCY

SEQ ID NO: 2419 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AGCCEFXCNPACTGX

SEQ ID NO: 2420 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AGCCEFXCNPACTGXK

SEQ ID NO: 2421 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AGCCEFXCNPACTGXY

SEQ ID NO: 2422 - protein, 15 aa, Artificial Sequence
  Synthetically generated peptide
  misc_feature (7)..(7): Xaa can be Cys or D-Cys
AGCCEFXCTPACTGC

SEQ ID NO: 2423 - protein, 16 aa, Artificial Sequence
  Synthetically generated peptide
  misc_feature (7)..(7): Xaa can be Cys or D-Cys
AGCCEFXCTPACTGCK

SEQ ID NO: 2424 - protein, 16 aa, Artificial Sequence
  Synthetically generated peptide
  misc_feature (7)..(7): Xaa can be Cys or D-Cys
AGCCEFXCTPACTGCY

SEQ ID NO: 2425 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AGCCEFXCTPACTGX

SEQ ID NO: 2426 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AGCCEFXCTPACTGXK

SEQ ID NO: 2427 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AGCCEFXCTPACTGXY

SEQ ID NO: 2428 - protein, 15 aa, Artificial Sequence
  Synthetically generated peptide
AGCCEWCCNPACTGC

SEQ ID NO: 2429 - protein, 16 aa, Artificial Sequence
  Synthetically generated peptide
AGCCEWCCNPACTGCK

SEQ ID NO: 2430 - protein, 16 aa, Artificial Sequence
  Synthetically generated peptide
AGCCEWCCNPACTGCY

SEQ ID NO: 2431 - protein, 15 aa, Artificial Sequence
  Synthetically generated peptide
  misc_feature (15)..(15): Xaa can be Cys or D-Cys
AGCCEWCCNPACTGX

SEQ ID NO: 2432 - protein, 16 aa, Artificial Sequence
  Synthetically generated peptide
  misc_feature (15)..(15): Xaa can be Cys or D-Cys
AGCCEWCCNPACTGXK

SEQ ID NO: 2433 - protein, 16 aa, Artificial Sequence
  Synthetically generated peptide
  misc_feature (15)..(15): Xaa can be Cys or D-Cys
AGCCEWCCNPACTGXY

SEQ ID NO: 2434 - protein, 15 aa, Artificial Sequence
  Synthetically generated peptide
AGCCEWCCTPACTGC

SEQ ID NO: 2435 - protein, 16 aa, Artificial Sequence
  Synthetically generated peptide
AGCCEWCCTPACTGCK

SEQ ID NO: 2436 - protein, 16 aa, Artificial Sequence
  Synthetically generated peptide
AGCCEWCCTPACTGCY

SEQ ID NO: 2437 - protein, 15 aa, Artificial Sequence
  Synthetically generated peptide
  misc_feature (15)..(15): Xaa can be Cys or D-Cys
AGCCEWCCTPACTGX

SEQ ID NO: 2438 - protein, 16 aa, Artificial Sequence
  Synthetically generated peptide
  misc_feature (15)..(15): Xaa can be Cys or D-Cys
AGCCEWCCTPACTGXK

SEQ ID NO: 2439 - protein, 16 aa, Artificial Sequence
  Synthetically generated peptide
  misc_feature (15)..(15): Xaa can be Cys or D-Cys
AGCCEWCCTPACTGXY

SEQ ID NO: 2440 - protein, 15 aa, Artificial Sequence
  Synthetically generated peptide
  misc_feature (7)..(7): Xaa can be Cys or D-Cys
AGCCEWXCNPACTGC

SEQ ID NO: 2441 - protein, 16 aa, Artificial Sequence
  Synthetically generated peptide
  misc_feature (7)..(7): Xaa can be Cys or D-Cys
AGCCEWXCNPACTGCK

SEQ ID NO: 2442 - protein, 16 aa, Artificial Sequence
  Synthetically generated peptide
  misc_feature (7)..(7): Xaa can be Cys or D-Cys
AGCCEWXCNPACTGCY

SEQ ID NO: 2443 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AGCCEWXCNPACTGX

SEQ ID NO: 2444 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AGCCEWXCNPACTGXK

SEQ ID NO: 2445 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AGCCEWXCNPACTGXY

SEQ ID NO: 2446 - protein, 15 aa, Artificial Sequence
  Synthetically generated peptide
  misc_feature (7)..(7): Xaa can be Cys or D-Cys
AGCCEWXCTPACTGC

SEQ ID NO: 2447 - protein, 16 aa, Artificial Sequence
  Synthetically generated peptide
  misc_feature (7)..(7): Xaa can be Cys or D-Cys
AGCCEWXCTPACTGCK

SEQ ID NO: 2448 - protein, 16 aa, Artificial Sequence
  Synthetically generated peptide
  misc_feature (7)..(7): Xaa can be Cys or D-Cys
AGCCEWXCTPACTGCY

SEQ ID NO: 2449 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AGCCEWXCTPACTGX

SEQ ID NO: 2450 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AGCCEWXCTPACTGXK

SEQ ID NO: 2451 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AGCCEWXCTPACTGXY

SEQ ID NO: 2452 - protein, 15 aa, Artificial Sequence
  Synthetically generated peptide
  misc_feature (3)..(3): Xaa can be Cys or D-Cys
AGXCEVCCNPACTGC

SEQ ID NO: 2453 - protein, 16 aa, Artificial Sequence
  Synthetically generated peptide
  misc_feature (3)..(3): Xaa can be Cys or D-Cys
AGXCEVCCNPACTGCK

SEQ ID NO: 2454 - protein, 16 aa, Artificial Sequence
  Synthetically generated peptide
  misc_feature (3)..(3): Xaa can be Cys or D-Cys
AGXCEVCCNPACTGCY

SEQ ID NO: 2455 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AGXCEVCCNPACTGX

SEQ ID NO: 2456 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AGXCEVCCNPACTGXK

SEQ ID NO: 2457 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AGXCEVCCNPACTGXY

SEQ ID NO: 2458 - protein, 15 aa, Artificial Sequence
  Synthetically generated peptide
  misc_feature (3)..(3): Xaa can be Cys or D-Cys
AGXCEVCCTPACTGC

SEQ ID NO: 2459 - protein, 16 aa, Artificial Sequence
  Synthetically generated peptide
  misc_feature (3)..(3): Xaa can be Cys or D-Cys
AGXCEVCCTPACTGCK

SEQ ID NO: 2460 - protein, 16 aa, Artificial Sequence
  Synthetically generated peptide
  misc_feature (3)..(3): Xaa can be Cys or D-Cys
AGXCEVCCTPACTGCY

SEQ ID NO: 2461 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AGXCEVCCTPACTGX

SEQ ID NO: 2462 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AGXCEVCCTPACTGXK

SEQ ID NO: 2463 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AGXCEVCCTPACTGXY

SEQ ID NO: 2464 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AGXCEVXCNPACTGC

SEQ ID NO: 2465 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AGXCEVXCNPACTGCK

SEQ ID NO: 2466 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AGXCEVXCNPACTGCY

SEQ ID NO: 2467 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCEVXCNPACTGX

SEQ ID NO: 2468 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCEVXCNPACTGXK

SEQ ID NO: 2469 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCEVXCNPACTGXY

SEQ ID NO: 2470 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AGXCEVXCTPACTGC

SEQ ID NO: 2471 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AGXCEVXCTPACTGCK

SEQ ID NO: 2472 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AGXCEVXCTPACTGCY

SEQ ID NO: 2473 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCEVXCTPACTGX

SEQ ID NO: 2474 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCEVXCTPACTGXK

SEQ ID NO: 2475 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCEVXCTPACTGXY

SEQ ID NO: 2476 - protein, 15 aa, Artificial Sequence
  Synthetically generated peptide
  misc_feature (3)..(3): Xaa can be Cys or D-Cys
AGXCEICCNPACTGC

SEQ ID NO: 2477 - protein, 16 aa, Artificial Sequence
  Synthetically generated peptide
  misc_feature (3)..(3): Xaa can be Cys or D-Cys
AGXCEICCNPACTGCK

SEQ ID NO: 2478 - protein, 16 aa, Artificial Sequence
  Synthetically generated peptide
  misc_feature (3)..(3): Xaa can be Cys or D-Cys
AGXCEICCNPACTGCY

SEQ ID NO: 2479 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AGXCEICCNPACTGX

SEQ ID NO: 2480 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AGXCEICCNPACTGXK

SEQ ID NO: 2481 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AGXCEICCNPACTGXY

SEQ ID NO: 2482 - protein, 15 aa, Artificial Sequence
  Synthetically generated peptide
  misc_feature (3)..(3): Xaa can be Cys or D-Cys
AGXCEICCTPACTGC

SEQ ID NO: 2483 - protein, 16 aa, Artificial Sequence
  Synthetically generated peptide
  misc_feature (3)..(3): Xaa can be Cys or D-Cys
AGXCEICCTPACTGCK

SEQ ID NO: 2484 - protein, 16 aa, Artificial Sequence
  Synthetically generated peptide
  misc_feature (3)..(3): Xaa can be Cys or D-Cys
AGXCEICCTPACTGCY

SEQ ID NO: 2485 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AGXCEICCTPACTGX

SEQ ID NO: 2486 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AGXCEICCTPACTGXK

SEQ ID NO: 2487 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AGXCEICCTPACTGXY

SEQ ID NO: 2488 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AGXCEIXCNPACTGC

SEQ ID NO: 2489 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AGXCEIXCNPACTGCK

SEQ ID NO: 2490 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AGXCEIXCNPACTGCY

SEQ ID NO: 2491 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCEIXCNPACTGX

SEQ ID NO: 2492 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCEIXCNPACTGXK

SEQ ID NO: 2493 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCEIXCNPACTGXY

SEQ ID NO: 2494 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AGXCEIXCTPACTGC

SEQ ID NO: 2495 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AGXCEIXCTPACTGCK

SEQ ID NO: 2496 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AGXCEIXCTPACTGCY

SEQ ID NO: 2497 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCEIXCTPACTGX

SEQ ID NO: 2498 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCEIXCTPACTGXK

SEQ ID NO: 2499 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCEIXCTPACTGXY

SEQ ID NO: 2500 - protein, 15 aa, Artificial Sequence
  Synthetically generated peptide
  misc_feature (3)..(3): Xaa can be Cys or D-Cys
AGXCELCCNPACTGC

SEQ ID NO: 2501 - protein, 16 aa, Artificial Sequence
  Synthetically generated peptide
  misc_feature (3)..(3): Xaa can be Cys or D-Cys
AGXCELCCNPACTGCK

SEQ ID NO: 2502 - protein, 16 aa, Artificial Sequence
  Synthetically generated peptide
  misc_feature (3)..(3): Xaa can be Cys or D-Cys
AGXCELCCNPACTGCY

SEQ ID NO: 2503 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AGXCELCCNPACTGX

SEQ ID NO: 2504 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AGXCELCCNPACTGXK

SEQ ID NO: 2505 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AGXCELCCNPACTGXY

SEQ ID NO: 2506 - protein, 15 aa, Artificial Sequence
  Synthetically generated peptide
  misc_feature (3)..(3): Xaa can be Cys or D-Cys
AGXCELCCTPACTGC

SEQ ID NO: 2507 - protein, 16 aa, Artificial Sequence
  Synthetically generated peptide
  misc_feature (3)..(3): Xaa can be Cys or D-Cys
AGXCELCCTPACTGCK

SEQ ID NO: 2508 - protein, 16 aa, Artificial Sequence
  Synthetically generated peptide
  misc_feature (3)..(3): Xaa can be Cys or D-Cys
AGXCELCCTPACTGCY

SEQ ID NO: 2509 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AGXCELCCTPACTGX

SEQ ID NO: 2510 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AGXCELCCTPACTGXK

SEQ ID NO: 2511 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AGXCELCCTPACTGXY

SEQ ID NO: 2512 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AGXCELXCNPACTGC

SEQ ID NO: 2513 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AGXCELXCNPACTGCK

SEQ ID NO: 2514 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AGXCELXCNPACTGCY

SEQ ID NO: 2515 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCELXCNPACTGX

SEQ ID NO: 2516 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCELXCNPACTGXK

SEQ ID NO: 2517 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCELXCNPACTGXY

SEQ ID NO: 2518 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AGXCELXCTPACTGC

SEQ ID NO: 2519 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AGXCELXCTPACTGCK

SEQ ID NO: 2520 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AGXCELXCTPACTGCY

SEQ ID NO: 2521 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCELXCTPACTGX

SEQ ID NO: 2522 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCELXCTPACTGXK

SEQ ID NO: 2523 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCELXCTPACTGXY

SEQ ID NO: 2524 - protein, 15 aa, Artificial Sequence
  Synthetically generated peptide
  misc_feature (3)..(3): Xaa can be Cys or D-Cys
AGXCEYCCNPACTGC

SEQ ID NO: 2525 - protein, 16 aa, Artificial Sequence
  Synthetically generated peptide
  misc_feature (3)..(3): Xaa can be Cys or D-Cys
AGXCEYCCNPACTGCK

SEQ ID NO: 2526 - protein, 16 aa, Artificial Sequence
  Synthetically generated peptide
  misc_feature (3)..(3): Xaa can be Cys or D-Cys
AGXCEYCCNPACTGCY

SEQ ID NO: 2527 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AGXCEYCCNPACTGX

SEQ ID NO: 2528 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AGXCEYCCNPACTGXK

SEQ ID NO: 2529 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AGXCEYCCNPACTGXY

SEQ ID NO: 2530 - protein, 15 aa, Artificial Sequence
  Synthetically generated peptide
  misc_feature (3)..(3): Xaa can be Cys or D-Cys
AGXCEYCCTPACTGC

SEQ ID NO: 2531 - protein, 16 aa, Artificial Sequence
  Synthetically generated peptide
  misc_feature (3)..(3): Xaa can be Cys or D-Cys
AGXCEYCCTPACTGCK

SEQ ID NO: 2532 - protein, 16 aa, Artificial Sequence
  Synthetically generated peptide
  misc_feature (3)..(3): Xaa can be Cys or D-Cys
AGXCEYCCTPACTGCY

SEQ ID NO: 2533 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AGXCEYCCTPACTGX

SEQ ID NO: 2534 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AGXCEYCCTPACTGXK

SEQ ID NO: 2535 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AGXCEYCCTPACTGXY

SEQ ID NO: 2536 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AGXCEYXCNPACTGC

SEQ ID NO: 2537 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AGXCEYXCNPACTGCK

SEQ ID NO: 2538 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AGXCEYXCNPACTGCY

SEQ ID NO: 2539 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCEYXCNPACTGX

SEQ ID NO: 2540 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCEYXCNPACTGXK

SEQ ID NO: 2541 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCEYXCNPACTGXY

SEQ ID NO: 2542 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AGXCEYXCTPACTGC

SEQ ID NO: 2543 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AGXCEYXCTPACTGCK

SEQ ID NO: 2544 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AGXCEYXCTPACTGCY

SEQ ID NO: 2545 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCEYXCTPACTGX

SEQ ID NO: 2546 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCEYXCTPACTGXK

SEQ ID NO: 2547 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCEYXCTPACTGXY

SEQ ID NO: 2548 - protein, 15 aa, Artificial Sequence
  Synthetically generated peptide
  misc_feature (3)..(3): Xaa can be Cys or D-Cys
AGXCEFCCNPACTGC

SEQ ID NO: 2549 - protein, 16 aa, Artificial Sequence
  Synthetically generated peptide
  misc_feature (3)..(3): Xaa can be Cys or D-Cys
AGXCEFCCNPACTGCK

SEQ ID NO: 2550 - protein, 16 aa, Artificial Sequence
  Synthetically generated peptide
  misc_feature (3)..(3): Xaa can be Cys or D-Cys
AGXCEFCCNPACTGCY

SEQ ID NO: 2551 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AGXCEFCCNPACTGX

SEQ ID NO: 2552 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AGXCEFCCNPACTGXK

SEQ ID NO: 2553 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AGXCEFCCNPACTGXY

SEQ ID NO: 2554 - protein, 15 aa, Artificial Sequence
  Synthetically generated peptide
  misc_feature (3)..(3): Xaa can be Cys or D-Cys
AGXCEFCCTPACTGC

SEQ ID NO: 2555 - protein, 16 aa, Artificial Sequence
  Synthetically generated peptide
  misc_feature (3)..(3): Xaa can be Cys or D-Cys
AGXCEFCCTPACTGCK

SEQ ID NO: 2556 - protein, 16 aa, Artificial Sequence
  Synthetically generated peptide
  misc_feature (3)..(3): Xaa can be Cys or D-Cys
AGXCEFCCTPACTGCY

SEQ ID NO: 2557 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AGXCEFCCTPACTGX

SEQ ID NO: 2558 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AGXCEFCCTPACTGXK

SEQ ID NO: 2559 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AGXCEFCCTPACTGXY

SEQ ID NO: 2560 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AGXCEFXCNPACTGC

SEQ ID NO: 2561 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AGXCEFXCNPACTGCK

SEQ ID NO: 2562 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AGXCEFXCNPACTGCY

SEQ ID NO: 2563 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCEFXCNPACTGX

SEQ ID NO: 2564 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCEFXCNPACTGXK

SEQ ID NO: 2565 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCEFXCNPACTGXY

SEQ ID NO: 2566 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AGXCEFXCTPACTGC

SEQ ID NO: 2567 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AGXCEFXCTPACTGCK

SEQ ID NO: 2568 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AGXCEFXCTPACTGCY

SEQ ID NO: 2569 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCEFXCTPACTGX

SEQ ID NO: 2570 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCEFXCTPACTGXK

SEQ ID NO: 2571 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCEFXCTPACTGXY

SEQ ID NO: 2572 - protein, 15 aa, Artificial Sequence
  Synthetically generated peptide
  misc_feature (3)..(3): Xaa can be Cys or D-Cys
AGXCEWCCNPACTGC

SEQ ID NO: 2573 - protein, 16 aa, Artificial Sequence
  Synthetically generated peptide
  misc_feature (3)..(3): Xaa can be Cys or D-Cys
AGXCEWCCNPACTGCK

SEQ ID NO: 2574 - protein, 16 aa, Artificial Sequence
  Synthetically generated peptide
  misc_feature (3)..(3): Xaa can be Cys or D-Cys
AGXCEWCCNPACTGCY

SEQ ID NO: 2575 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AGXCEWCCNPACTGX

SEQ ID NO: 2576 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AGXCEWCCNPACTGXK

SEQ ID NO: 2577 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AGXCEWCCNPACTGXY

SEQ ID NO: 2578 - protein, 15 aa, Artificial Sequence
  Synthetically generated peptide
  misc_feature (3)..(3): Xaa can be Cys or D-Cys
AGXCEWCCTPACTGC

SEQ ID NO: 2579 - protein, 16 aa, Artificial Sequence
  Synthetically generated peptide
  misc_feature (3)..(3): Xaa can be Cys or D-Cys
AGXCEWCCTPACTGCK

SEQ ID NO: 2580 - protein, 16 aa, Artificial Sequence
  Synthetically generated peptide
  misc_feature (3)..(3): Xaa can be Cys or D-Cys
AGXCEWCCTPACTGCY

SEQ ID NO: 2581 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AGXCEWCCTPACTGX

SEQ ID NO: 2582 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AGXCEWCCTPACTGXK

SEQ ID NO: 2583 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AGXCEWCCTPACTGXY

SEQ ID NO: 2584 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AGXCEWXCNPACTGC

SEQ ID NO: 2585 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AGXCEWXCNPACTGCK

SEQ ID NO: 2586 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AGXCEWXCNPACTGCY

SEQ ID NO: 2587 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCEWXCNPACTGX

SEQ ID NO: 2588 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCEWXCNPACTGXK

SEQ ID NO: 2589 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCEWXCNPACTGXY

SEQ ID NO: 2590 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AGXCEWXCTPACTGC

SEQ ID NO: 2591 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AGXCEWXCTPACTGCK

SEQ ID NO: 2592 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AGXCEWXCTPACTGCY

SEQ ID NO: 2593 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCEWXCTPACTGX

SEQ ID NO: 2594 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCEWXCTPACTGXK

SEQ ID NO: 2595 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AGXCEWXCTPACTGXY

SEQ ID NO: 2596 - protein, 15 aa, Artificial Sequence
  Synthetically generated peptide
AKCCEVCCNPACTGC

SEQ ID NO: 2597 - protein, 16 aa, Artificial Sequence
  Synthetically generated peptide
AKCCEVCCNPACTGCK

SEQ ID NO: 2598 - protein, 16 aa, Artificial Sequence
  Synthetically generated peptide
AKCCEVCCNPACTGCY

SEQ ID NO: 2599 - protein, 15 aa, Artificial Sequence
  Synthetically generated peptide
  misc_feature (15)..(15): Xaa can be Cys or D-Cys
AKCCEVCCNPACTGX

SEQ ID NO: 2600 - protein, 16 aa, Artificial Sequence
  Synthetically generated peptide
  misc_feature (15)..(15): Xaa can be Cys or D-Cys
AKCCEVCCNPACTGXK

SEQ ID NO: 2601 - protein, 16 aa, Artificial Sequence
  Synthetically generated peptide
  misc_feature (15)..(15): Xaa can be Cys or D-Cys
AKCCEVCCNPACTGXY

SEQ ID NO: 2602 - protein, 15 aa, Artificial Sequence
  Synthetically generated peptide
AKCCEVCCTPACTGC

SEQ ID NO: 2603 - protein, 16 aa, Artificial Sequence
  Synthetically generated peptide
AKCCEVCCTPACTGCK

SEQ ID NO: 2604 - protein, 16 aa, Artificial Sequence
  Synthetically generated peptide
AKCCEVCCTPACTGCY

SEQ ID NO: 2605 - protein, 15 aa, Artificial Sequence
  Synthetically generated peptide
  misc_feature (15)..(15): Xaa can be Cys or D-Cys
AKCCEVCCTPACTGX

SEQ ID NO: 2606 - protein, 16 aa, Artificial Sequence
  Synthetically generated peptide
  misc_feature (15)..(15): Xaa can be Cys or D-Cys
AKCCEVCCTPACTGXK

SEQ ID NO: 2607 - protein, 16 aa, Artificial Sequence
  Synthetically generated peptide
  misc_feature (15)..(15): Xaa can be Cys or D-Cys
AKCCEVCCTPACTGXY

SEQ ID NO: 2608 - protein, 15 aa, Artificial Sequence
  Synthetically generated peptide
  misc_feature (7)..(7): Xaa can be Cys or D-Cys
AKCCEVXCNPACTGC

SEQ ID NO: 2609 - protein, 16 aa, Artificial Sequence
  Synthetically generated peptide
  misc_feature (7)..(7): Xaa can be Cys or D-Cys
AKCCEVXCNPACTGCK

SEQ ID NO: 2610 - protein, 16 aa, Artificial Sequence
  Synthetically generated peptide
  misc_feature (7)..(7): Xaa can be Cys or D-Cys
AKCCEVXCNPACTGCY

SEQ ID NO: 2611 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AKCCEVXCNPACTGX

SEQ ID NO: 2612 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AKCCEVXCNPACTGXK

SEQ ID NO: 2613 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AKCCEVXCNPACTGXY

SEQ ID NO: 2614 - protein, 15 aa, Artificial Sequence
  Synthetically generated peptide
  misc_feature (7)..(7): Xaa can be Cys or D-Cys
AKCCEVXCTPACTGC

SEQ ID NO: 2615 - protein, 16 aa, Artificial Sequence
  Synthetically generated peptide
  misc_feature (7)..(7): Xaa can be Cys or D-Cys
AKCCEVXCTPACTGCK

SEQ ID NO: 2616 - protein, 16 aa, Artificial Sequence
  Synthetically generated peptide
  misc_feature (7)..(7): Xaa can be Cys or D-Cys
AKCCEVXCTPACTGCY

SEQ ID NO: 2617 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AKCCEVXCTPACTGX

SEQ ID NO: 2618 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AKCCEVXCTPACTGXK

SEQ ID NO: 2619 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AKCCEVXCTPACTGXY

SEQ ID NO: 2620 - protein, 15 aa, Artificial Sequence
  Synthetically generated peptide
AKCCEICCNPACTGC

SEQ ID NO: 2621 - protein, 16 aa, Artificial Sequence
  Synthetically generated peptide
AKCCEICCNPACTGCK

SEQ ID NO: 2622 - protein, 16 aa, Artificial Sequence
  Synthetically generated peptide
AKCCEICCNPACTGCY

SEQ ID NO: 2623 - protein, 15 aa, Artificial Sequence
  Synthetically generated peptide
  misc_feature (15)..(15): Xaa can be Cys or D-Cys
AKCCEICCNPACTGX

SEQ ID NO: 2624 - protein, 16 aa, Artificial Sequence
  Synthetically generated peptide
  misc_feature (15)..(15): Xaa can be Cys or D-Cys
AKCCEICCNPACTGXK

SEQ ID NO: 2625 - protein, 16 aa, Artificial Sequence
  Synthetically generated peptide
  misc_feature (15)..(15): Xaa can be Cys or D-Cys
AKCCEICCNPACTGXY

SEQ ID NO: 2626 - protein, 15 aa, Artificial Sequence
  Synthetically generated peptide
AKCCEICCTPACTGC

SEQ ID NO: 2627 - protein, 16 aa, Artificial Sequence
  Synthetically generated peptide
AKCCEICCTPACTGCK

SEQ ID NO: 2628 - protein, 16 aa, Artificial Sequence
  Synthetically generated peptide
AKCCEICCTPACTGCY

SEQ ID NO: 2629 - protein, 15 aa, Artificial Sequence
  Synthetically generated peptide
  misc_feature (15)..(15): Xaa can be Cys or D-Cys
AKCCEICCTPACTGX

SEQ ID NO: 2630 - protein, 16 aa, Artificial Sequence
  Synthetically generated peptide
  misc_feature (15)..(15): Xaa can be Cys or D-Cys
AKCCEICCTPACTGXK

SEQ ID NO: 2631 - protein, 16 aa, Artificial Sequence
  Synthetically generated peptide
  misc_feature (15)..(15): Xaa can be Cys or D-Cys
AKCCEICCTPACTGXY

SEQ ID NO: 2632 - protein, 15 aa, Artificial Sequence
  Synthetically generated peptide
  misc_feature (7)..(7): Xaa can be Cys or D-Cys
AKCCEIXCNPACTGC

SEQ ID NO: 2633 - protein, 16 aa, Artificial Sequence
  Synthetically generated peptide
  misc_feature (7)..(7): Xaa can be Cys or D-Cys
AKCCEIXCNPACTGCK

SEQ ID NO: 2634 - protein, 16 aa, Artificial Sequence
  Synthetically generated peptide
  misc_feature (7)..(7): Xaa can be Cys or D-Cys
AKCCEIXCNPACTGCY

SEQ ID NO: 2635 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AKCCEIXCNPACTGX

SEQ ID NO: 2636 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AKCCEIXCNPACTGXK

SEQ ID NO: 2637 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AKCCEIXCNPACTGXY

SEQ ID NO: 2638 - protein, 15 aa, Artificial Sequence
  Synthetically generated peptide
  misc_feature (7)..(7): Xaa can be Cys or D-Cys
AKCCEIXCTPACTGC

SEQ ID NO: 2639 - protein, 16 aa, Artificial Sequence
  Synthetically generated peptide
  misc_feature (7)..(7): Xaa can be Cys or D-Cys
AKCCEIXCTPACTGCK

SEQ ID NO: 2640 - protein, 16 aa, Artificial Sequence
  Synthetically generated peptide
  misc_feature (7)..(7): Xaa can be Cys or D-Cys
AKCCEIXCTPACTGCY

SEQ ID NO: 2641 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AKCCEIXCTPACTGX

SEQ ID NO: 2642 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AKCCEIXCTPACTGXK

SEQ ID NO: 2643 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AKCCEIXCTPACTGXY

SEQ ID NO: 2644 - protein, 15 aa, Artificial Sequence
  Synthetically generated peptide
AKCCELCCNPACTGC

SEQ ID NO: 2645 - protein, 16 aa, Artificial Sequence
  Synthetically generated peptide
AKCCELCCNPACTGCK

SEQ ID NO: 2646 - protein, 16 aa, Artificial Sequence
  Synthetically generated peptide
AKCCELCCNPACTGCY

SEQ ID NO: 2647 - protein, 15 aa, Artificial Sequence
  Synthetically generated peptide
  misc_feature (15)..(15): Xaa can be Cys or D-Cys
AKCCELCCNPACTGX

SEQ ID NO: 2648 - protein, 16 aa, Artificial Sequence
  Synthetically generated peptide
  misc_feature (15)..(15): Xaa can be Cys or D-Cys
AKCCELCCNPACTGXK

SEQ ID NO: 2649 - protein, 16 aa, Artificial Sequence
  Synthetically generated peptide
  misc_feature (15)..(15): Xaa can be Cys or D-Cys
AKCCELCCNPACTGXY

SEQ ID NO: 2650 - protein, 15 aa, Artificial Sequence
  Synthetically generated peptide
AKCCELCCTPACTGC

SEQ ID NO: 2651 - protein, 16 aa, Artificial Sequence
  Synthetically generated peptide
AKCCELCCTPACTGCK

SEQ ID NO: 2652 - protein, 16 aa, Artificial Sequence
  Synthetically generated peptide
AKCCELCCTPACTGCY

SEQ ID NO: 2653 - protein, 15 aa, Artificial Sequence
  Synthetically generated peptide
  misc_feature (15)..(15): Xaa can be Cys or D-Cys
AKCCELCCTPACTGX

SEQ ID NO: 2654 - protein, 16 aa, Artificial Sequence
  Synthetically generated peptide
  misc_feature (15)..(15): Xaa can be Cys or D-Cys
AKCCELCCTPACTGXK

SEQ ID NO: 2655 - protein, 16 aa, Artificial Sequence
  Synthetically generated peptide
  misc_feature (15)..(15): Xaa can be Cys or D-Cys
AKCCELCCTPACTGXY

SEQ ID NO: 2656 - protein, 15 aa, Artificial Sequence
  Synthetically generated peptide
  misc_feature (7)..(7): Xaa can be Cys or D-Cys
AKCCELXCNPACTGC

SEQ ID NO: 2657 - protein, 16 aa, Artificial Sequence
  Synthetically generated peptide
  misc_feature (7)..(7): Xaa can be Cys or D-Cys
AKCCELXCNPACTGCK

SEQ ID NO: 2658 - protein, 16 aa, Artificial Sequence
  Synthetically generated peptide
  misc_feature (7)..(7): Xaa can be Cys or D-Cys
AKCCELXCNPACTGCY

SEQ ID NO: 2659 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AKCCELXCNPACTGX

SEQ ID NO: 2660 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AKCCELXCNPACTGXK

SEQ ID NO: 2661 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AKCCELXCNPACTGXY

SEQ ID NO: 2662 - protein, 15 aa, Artificial Sequence
  Synthetically generated peptide
  misc_feature (7)..(7): Xaa can be Cys or D-Cys
AKCCELXCTPACTGC

SEQ ID NO: 2663 - protein, 16 aa, Artificial Sequence
  Synthetically generated peptide
  misc_feature (7)..(7): Xaa can be Cys or D-Cys
AKCCELXCTPACTGCK

SEQ ID NO: 2664 - protein, 16 aa, Artificial Sequence
  Synthetically generated peptide
  misc_feature (7)..(7): Xaa can be Cys or D-Cys
AKCCELXCTPACTGCY

SEQ ID NO: 2665 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AKCCELXCTPACTGX

SEQ ID NO: 2666 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AKCCELXCTPACTGXK

SEQ ID NO: 2667 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AKCCELXCTPACTGXY

SEQ ID NO: 2668 - protein, 15 aa, Artificial Sequence
  Synthetically generated peptide
AKCCEYCCNPACTGC

SEQ ID NO: 2669 - protein, 16 aa, Artificial Sequence
  Synthetically generated peptide
AKCCEYCCNPACTGCK

SEQ ID NO: 2670 - protein, 16 aa, Artificial Sequence
  Synthetically generated peptide
AKCCEYCCNPACTGCY

SEQ ID NO: 2671 - protein, 15 aa, Artificial Sequence
  Synthetically generated peptide
  misc_feature (15)..(15): Xaa can be Cys or D-Cys
AKCCEYCCNPACTGX

SEQ ID NO: 2672 - protein, 16 aa, Artificial Sequence
  Synthetically generated peptide
  misc_feature (15)..(15): Xaa can be Cys or D-Cys
AKCCEYCCNPACTGXK

SEQ ID NO: 2673 - protein, 16 aa, Artificial Sequence
  Synthetically generated peptide
  misc_feature (15)..(15): Xaa can be Cys or D-Cys
AKCCEYCCNPACTGXY

SEQ ID NO: 2674 - protein, 15 aa, Artificial Sequence
  Synthetically generated peptide
AKCCEYCCTPACTGC

SEQ ID NO: 2675 - protein, 16 aa, Artificial Sequence
  Synthetically generated peptide
AKCCEYCCTPACTGCK

SEQ ID NO: 2676 - protein, 16 aa, Artificial Sequence
  Synthetically generated peptide
AKCCEYCCTPACTGCY

SEQ ID NO: 2677 - protein, 15 aa, Artificial Sequence
  Synthetically generated peptide
  misc_feature (15)..(15): Xaa can be Cys or D-Cys
AKCCEYCCTPACTGX

SEQ ID NO: 2678 - protein, 16 aa, Artificial Sequence
  Synthetically generated peptide
  misc_feature (15)..(15): Xaa can be Cys or D-Cys
AKCCEYCCTPACTGXK

SEQ ID NO: 2679 - protein, 16 aa, Artificial Sequence
  Synthetically generated peptide
  misc_feature (15)..(15): Xaa can be Cys or D-Cys
AKCCEYCCTPACTGXY

SEQ ID NO: 2680 - protein, 15 aa, Artificial Sequence
  Synthetically generated peptide
  misc_feature (7)..(7): Xaa can be Cys or D-Cys
AKCCEYXCNPACTGC

SEQ ID NO: 2681 - protein, 16 aa, Artificial Sequence
  Synthetically generated peptide
  misc_feature (7)..(7): Xaa can be Cys or D-Cys
AKCCEYXCNPACTGCK

SEQ ID NO: 2682 - protein, 16 aa, Artificial Sequence
  Synthetically generated peptide
  misc_feature (7)..(7): Xaa can be Cys or D-Cys
AKCCEYXCNPACTGCY

SEQ ID NO: 2683 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AKCCEYXCNPACTGX

SEQ ID NO: 2684 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AKCCEYXCNPACTGXK

SEQ ID NO: 2685 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AKCCEYXCNPACTGXY

SEQ ID NO: 2686 - protein, 15 aa, Artificial Sequence
  Synthetically generated peptide
  misc_feature (7)..(7): Xaa can be Cys or D-Cys
AKCCEYXCTPACTGC

SEQ ID NO: 2687 - protein, 16 aa, Artificial Sequence
  Synthetically generated peptide
  misc_feature (7)..(7): Xaa can be Cys or D-Cys
AKCCEYXCTPACTGCK

SEQ ID NO: 2688 - protein, 16 aa, Artificial Sequence
  Synthetically generated peptide
  misc_feature (7)..(7): Xaa can be Cys or D-Cys
AKCCEYXCTPACTGCY

SEQ ID NO: 2689 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AKCCEYXCTPACTGX

SEQ ID NO: 2690 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AKCCEYXCTPACTGXK

SEQ ID NO: 2691 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AKCCEYXCTPACTGXY

SEQ ID NO: 2692 - protein, 15 aa, Artificial Sequence
  Synthetically generated peptide
AKCCEFCCNPACTGC

SEQ ID NO: 2693 - protein, 16 aa, Artificial Sequence
  Synthetically generated peptide
AKCCEFCCNPACTGCK

SEQ ID NO: 2694 - protein, 16 aa, Artificial Sequence
  Synthetically generated peptide
AKCCEFCCNPACTGCY

SEQ ID NO: 2695 - protein, 15 aa, Artificial Sequence
  Synthetically generated peptide
  misc_feature (15)..(15): Xaa can be Cys or D-Cys
AKCCEFCCNPACTGX

SEQ ID NO: 2696 - protein, 16 aa, Artificial Sequence
  Synthetically generated peptide
  misc_feature (15)..(15): Xaa can be Cys or D-Cys
AKCCEFCCNPACTGXK

SEQ ID NO: 2697 - protein, 16 aa, Artificial Sequence
  Synthetically generated peptide
  misc_feature (15)..(15): Xaa can be Cys or D-Cys
AKCCEFCCNPACTGXY

SEQ ID NO: 2698 - protein, 15 aa, Artificial Sequence
  Synthetically generated peptide
AKCCEFCCTPACTGC

SEQ ID NO: 2699 - protein, 16 aa, Artificial Sequence
  Synthetically generated peptide
AKCCEFCCTPACTGCK

SEQ ID NO: 2700 - protein, 16 aa, Artificial Sequence
  Synthetically generated peptide
AKCCEFCCTPACTGCY

SEQ ID NO: 2701 - protein, 15 aa, Artificial Sequence
  Synthetically generated peptide
  misc_feature (15)..(15): Xaa can be Cys or D-Cys
AKCCEFCCTPACTGX

SEQ ID NO: 2702 - protein, 16 aa, Artificial Sequence
  Synthetically generated peptide
  misc_feature (15)..(15): Xaa can be Cys or D-Cys
AKCCEFCCTPACTGXK

SEQ ID NO: 2703 - protein, 16 aa, Artificial Sequence
  Synthetically generated peptide
  misc_feature (15)..(15): Xaa can be Cys or D-Cys
AKCCEFCCTPACTGXY

SEQ ID NO: 2704 - protein, 15 aa, Artificial Sequence
  Synthetically generated peptide
  misc_feature (7)..(7): Xaa can be Cys or D-Cys
AKCCEFXCNPACTGC

SEQ ID NO: 2705 - protein, 16 aa, Artificial Sequence
  Synthetically generated peptide
  misc_feature (7)..(7): Xaa can be Cys or D-Cys
AKCCEFXCNPACTGCK

SEQ ID NO: 2706 - protein, 16 aa, Artificial Sequence
  Synthetically generated peptide
  misc_feature (7)..(7): Xaa can be Cys or D-Cys
AKCCEFXCNPACTGCY

SEQ ID NO: 2707 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AKCCEFXCNPACTGX

SEQ ID NO: 2708 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AKCCEFXCNPACTGXK

SEQ ID NO: 2709 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AKCCEFXCNPACTGXY

SEQ ID NO: 2710 - protein, 15 aa, Artificial Sequence
  Synthetically generated peptide
  misc_feature (7)..(7): Xaa can be Cys or D-Cys
AKCCEFXCTPACTGC

SEQ ID NO: 2711 - protein, 16 aa, Artificial Sequence
  Synthetically generated peptide
  misc_feature (7)..(7): Xaa can be Cys or D-Cys
AKCCEFXCTPACTGCK

SEQ ID NO: 2712 - protein, 16 aa, Artificial Sequence
  Synthetically generated peptide
  misc_feature (7)..(7): Xaa can be Cys or D-Cys
AKCCEFXCTPACTGCY

SEQ ID NO: 2713 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AKCCEFXCTPACTGX

SEQ ID NO: 2714 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AKCCEFXCTPACTGXK

SEQ ID NO: 2715 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AKCCEFXCTPACTGXY

SEQ ID NO: 2716 - protein, 15 aa, Artificial Sequence
  Synthetically generated peptide
AKCCEWCCNPACTGC

SEQ ID NO: 2717 - protein, 16 aa, Artificial Sequence
  Synthetically generated peptide
AKCCEWCCNPACTGCK

SEQ ID NO: 2718 - protein, 16 aa, Artificial Sequence
  Synthetically generated peptide
AKCCEWCCNPACTGCY

SEQ ID NO: 2719 - protein, 15 aa, Artificial Sequence
  Synthetically generated peptide
  misc_feature (15)..(15): Xaa can be Cys or D-Cys
AKCCEWCCNPACTGX

SEQ ID NO: 2720 - protein, 16 aa, Artificial Sequence
  Synthetically generated peptide
  misc_feature (15)..(15): Xaa can be Cys or D-Cys
AKCCEWCCNPACTGXK

SEQ ID NO: 2721 - protein, 16 aa, Artificial Sequence
  Synthetically generated peptide
  misc_feature (15)..(15): Xaa can be Cys or D-Cys
AKCCEWCCNPACTGXY

SEQ ID NO: 2722 - protein, 15 aa, Artificial Sequence
  Synthetically generated peptide
AKCCEWCCTPACTGC

SEQ ID NO: 2723 - protein, 16 aa, Artificial Sequence
  Synthetically generated peptide
AKCCEWCCTPACTGCK

SEQ ID NO: 2724 - protein, 16 aa, Artificial Sequence
  Synthetically generated peptide
AKCCEWCCTPACTGCY

SEQ ID NO: 2725 - protein, 15 aa, Artificial Sequence
  Synthetically generated peptide
  misc_feature (15)..(15): Xaa can be Cys or D-Cys
AKCCEWCCTPACTGX

SEQ ID NO: 2726 - protein, 16 aa, Artificial Sequence
  Synthetically generated peptide
  misc_feature (15)..(15): Xaa can be Cys or D-Cys
AKCCEWCCTPACTGXK

SEQ ID NO: 2727 - protein, 16 aa, Artificial Sequence
  Synthetically generated peptide
  misc_feature (15)..(15): Xaa can be Cys or D-Cys
AKCCEWCCTPACTGXY

SEQ ID NO: 2728 - protein, 15 aa, Artificial Sequence
  Synthetically generated peptide
  misc_feature (7)..(7): Xaa can be Cys or D-Cys
AKCCEWXCNPACTGC

SEQ ID NO: 2729 - protein, 16 aa, Artificial Sequence
  Synthetically generated peptide
  misc_feature (7)..(7): Xaa can be Cys or D-Cys
AKCCEWXCNPACTGCK

SEQ ID NO: 2730 - protein, 16 aa, Artificial Sequence
  Synthetically generated peptide
  misc_feature (7)..(7): Xaa can be Cys or D-Cys
AKCCEWXCNPACTGCY

SEQ ID NO: 2731 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AKCCEWXCNPACTGX

SEQ ID NO: 2732 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AKCCEWXCNPACTGXK

SEQ ID NO: 2733 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AKCCEWXCNPACTGXY

SEQ ID NO: 2734 - protein, 15 aa, Artificial Sequence
  Synthetically generated peptide
  misc_feature (7)..(7): Xaa can be Cys or D-Cys
AKCCEWXCTPACTGC

SEQ ID NO: 2735 - protein, 16 aa, Artificial Sequence
  Synthetically generated peptide
  misc_feature (7)..(7): Xaa can be Cys or D-Cys
AKCCEWXCTPACTGCK

SEQ ID NO: 2736 - protein, 16 aa, Artificial Sequence
  Synthetically generated peptide
  misc_feature (7)..(7): Xaa can be Cys or D-Cys
AKCCEWXCTPACTGCY

SEQ ID NO: 2737 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AKCCEWXCTPACTGX

SEQ ID NO: 2738 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AKCCEWXCTPACTGXK

SEQ ID NO: 2739 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AKCCEWXCTPACTGXY

SEQ ID NO: 2740 - protein, 15 aa, Artificial Sequence
  Synthetically generated peptide
  misc_feature (3)..(3): Xaa can be Cys or D-Cys
AKXCEVCCNPACTGC

SEQ ID NO: 2741 - protein, 16 aa, Artificial Sequence
  Synthetically generated peptide
  misc_feature (3)..(3): Xaa can be Cys or D-Cys
AKXCEVCCNPACTGCK

SEQ ID NO: 2742 - protein, 16 aa, Artificial Sequence
  Synthetically generated peptide
  misc_feature (3)..(3): Xaa can be Cys or D-Cys
AKXCEVCCNPACTGCY

SEQ ID NO: 2743 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AKXCEVCCNPACTGX

SEQ ID NO: 2744 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AKXCEVCCNPACTGXK

SEQ ID NO: 2745 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AKXCEVCCNPACTGXY

SEQ ID NO: 2746 - protein, 15 aa, Artificial Sequence
  Synthetically generated peptide
  misc_feature (3)..(3): Xaa can be Cys or D-Cys
AKXCEVCCTPACTGC

SEQ ID NO: 2747 - protein, 16 aa, Artificial Sequence
  Synthetically generated peptide
  misc_feature (3)..(3): Xaa can be Cys or D-Cys
AKXCEVCCTPACTGCK

SEQ ID NO: 2748 - protein, 16 aa, Artificial Sequence
  Synthetically generated peptide
  misc_feature (3)..(3): Xaa can be Cys or D-Cys
AKXCEVCCTPACTGCY

SEQ ID NO: 2749 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AKXCEVCCTPACTGX

SEQ ID NO: 2750 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AKXCEVCCTPACTGXK

SEQ ID NO: 2751 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AKXCEVCCTPACTGXY

SEQ ID NO: 2752 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AKXCEVXCNPACTGC

SEQ ID NO: 2753 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AKXCEVXCNPACTGCK

SEQ ID NO: 2754 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AKXCEVXCNPACTGCY

SEQ ID NO: 2755 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCEVXCNPACTGX

SEQ ID NO: 2756 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCEVXCNPACTGXK

SEQ ID NO: 2757 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCEVXCNPACTGXY

SEQ ID NO: 2758 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AKXCEVXCTPACTGC

SEQ ID NO: 2759 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AKXCEVXCTPACTGCK

SEQ ID NO: 2760 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AKXCEVXCTPACTGCY

SEQ ID NO: 2761 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCEVXCTPACTGX

SEQ ID NO: 2762 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCEVXCTPACTGXK

SEQ ID NO: 2763 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCEVXCTPACTGXY

SEQ ID NO: 2764 - protein, 15 aa, Artificial Sequence
  Synthetically generated peptide
  misc_feature (3)..(3): Xaa can be Cys or D-Cys
AKXCEICCNPACTGC

SEQ ID NO: 2765 - protein, 16 aa, Artificial Sequence
  Synthetically generated peptide
  misc_feature (3)..(3): Xaa can be Cys or D-Cys
AKXCEICCNPACTGCK

SEQ ID NO: 2766 - protein, 16 aa, Artificial Sequence
  Synthetically generated peptide
  misc_feature (3)..(3): Xaa can be Cys or D-Cys
AKXCEICCNPACTGCY

SEQ ID NO: 2767 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AKXCEICCNPACTGX

SEQ ID NO: 2768 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AKXCEICCNPACTGXK

SEQ ID NO: 2769 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AKXCEICCNPACTGXY

SEQ ID NO: 2770 - protein, 15 aa, Artificial Sequence
  Synthetically generated peptide
  misc_feature (3)..(3): Xaa can be Cys or D-Cys
AKXCEICCTPACTGC

SEQ ID NO: 2771 - protein, 16 aa, Artificial Sequence
  Synthetically generated peptide
  misc_feature (3)..(3): Xaa can be Cys or D-Cys
AKXCEICCTPACTGCK

SEQ ID NO: 2772 - protein, 16 aa, Artificial Sequence
  Synthetically generated peptide
  misc_feature (3)..(3): Xaa can be Cys or D-Cys
AKXCEICCTPACTGCY

SEQ ID NO: 2773 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AKXCEICCTPACTGX

SEQ ID NO: 2774 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AKXCEICCTPACTGXK

SEQ ID NO: 2775 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AKXCEICCTPACTGXY

SEQ ID NO: 2776 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AKXCEIXCNPACTGC

SEQ ID NO: 2777 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AKXCEIXCNPACTGCK

SEQ ID NO: 2778 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AKXCEIXCNPACTGCY

SEQ ID NO: 2779 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCEIXCNPACTGX

SEQ ID NO: 2780 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCEIXCNPACTGXK

SEQ ID NO: 2781 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCEIXCNPACTGXY

SEQ ID NO: 2782 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AKXCEIXCTPACTGC

SEQ ID NO: 2783 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AKXCEIXCTPACTGCK

SEQ ID NO: 2784 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AKXCEIXCTPACTGCY

SEQ ID NO: 2785 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCEIXCTPACTGX

SEQ ID NO: 2786 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCEIXCTPACTGXK

SEQ ID NO: 2787 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCEIXCTPACTGXY

SEQ ID NO: 2788 - protein, 15 aa, Artificial Sequence
  Synthetically generated peptide
  misc_feature (3)..(3): Xaa can be Cys or D-Cys
AKXCELCCNPACTGC

SEQ ID NO: 2789 - protein, 16 aa, Artificial Sequence
  Synthetically generated peptide
  misc_feature (3)..(3): Xaa can be Cys or D-Cys
AKXCELCCNPACTGCK

SEQ ID NO: 2790 - protein, 16 aa, Artificial Sequence
  Synthetically generated peptide
  misc_feature (3)..(3): Xaa can be Cys or D-Cys
AKXCELCCNPACTGCY

SEQ ID NO: 2791 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AKXCELCCNPACTGX

SEQ ID NO: 2792 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AKXCELCCNPACTGXK

SEQ ID NO: 2793 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AKXCELCCNPACTGXY

SEQ ID NO: 2794 - protein, 15 aa, Artificial Sequence
  Synthetically generated peptide
  misc_feature (3)..(3): Xaa can be Cys or D-Cys
AKXCELCCTPACTGC

SEQ ID NO: 2795 - protein, 16 aa, Artificial Sequence
  Synthetically generated peptide
  misc_feature (3)..(3): Xaa can be Cys or D-Cys
AKXCELCCTPACTGCK

SEQ ID NO: 2796 - protein, 16 aa, Artificial Sequence
  Synthetically generated peptide
  misc_feature (3)..(3): Xaa can be Cys or D-Cys
AKXCELCCTPACTGCY

SEQ ID NO: 2797 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AKXCELCCTPACTGX

SEQ ID NO: 2798 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AKXCELCCTPACTGXK

SEQ ID NO: 2799 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AKXCELCCTPACTGXY

SEQ ID NO: 2800 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AKXCELXCNPACTGC

SEQ ID NO: 2801 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AKXCELXCNPACTGCK

SEQ ID NO: 2802 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AKXCELXCNPACTGCY

SEQ ID NO: 2803 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCELXCNPACTGX

SEQ ID NO: 2804 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCELXCNPACTGXK

SEQ ID NO: 2805 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCELXCNPACTGXY

SEQ ID NO: 2806 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AKXCELXCTPACTGC

SEQ ID NO: 2807 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AKXCELXCTPACTGCK

SEQ ID NO: 2808 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AKXCELXCTPACTGCY

SEQ ID NO: 2809 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCELXCTPACTGX

SEQ ID NO: 2810 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCELXCTPACTGXK

SEQ ID NO: 2811 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCELXCTPACTGXY

SEQ ID NO: 2812 - protein, 15 aa, Artificial Sequence
  Synthetically generated peptide
  misc_feature (3)..(3): Xaa can be Cys or D-Cys
AKXCEYCCNPACTGC

SEQ ID NO: 2813 - protein, 16 aa, Artificial Sequence
  Synthetically generated peptide
  misc_feature (3)..(3): Xaa can be Cys or D-Cys
AKXCEYCCNPACTGCK

SEQ ID NO: 2814 - protein, 16 aa, Artificial Sequence
  Synthetically generated peptide
  misc_feature (3)..(3): Xaa can be Cys or D-Cys
AKXCEYCCNPACTGCY

SEQ ID NO: 2815 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AKXCEYCCNPACTGX

SEQ ID NO: 2816 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AKXCEYCCNPACTGXK

SEQ ID NO: 2817 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AKXCEYCCNPACTGXY

SEQ ID NO: 2818 - protein, 15 aa, Artificial Sequence
  Synthetically generated peptide
  misc_feature (3)..(3): Xaa can be Cys or D-Cys
AKXCEYCCTPACTGC

SEQ ID NO: 2819 - protein, 16 aa, Artificial Sequence
  Synthetically generated peptide
  misc_feature (3)..(3): Xaa can be Cys or D-Cys
AKXCEYCCTPACTGCK

SEQ ID NO: 2820 - protein, 16 aa, Artificial Sequence
  Synthetically generated peptide
  misc_feature (3)..(3): Xaa can be Cys or D-Cys
AKXCEYCCTPACTGCY

SEQ ID NO: 2821 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AKXCEYCCTPACTGX

SEQ ID NO: 2822 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AKXCEYCCTPACTGXK

SEQ ID NO: 2823 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AKXCEYCCTPACTGXY

SEQ ID NO: 2824 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AKXCEYXCNPACTGC

SEQ ID NO: 2825 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AKXCEYXCNPACTGCK

SEQ ID NO: 2826 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AKXCEYXCNPACTGCY

SEQ ID NO: 2827 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCEYXCNPACTGX

SEQ ID NO: 2828 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCEYXCNPACTGXK

SEQ ID NO: 2829 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCEYXCNPACTGXY

SEQ ID NO: 2830 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AKXCEYXCTPACTGC

SEQ ID NO: 2831 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AKXCEYXCTPACTGCK

SEQ ID NO: 2832 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AKXCEYXCTPACTGCY

SEQ ID NO: 2833 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCEYXCTPACTGX

SEQ ID NO: 2834 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCEYXCTPACTGXK

SEQ ID NO: 2835 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCEYXCTPACTGXY

SEQ ID NO: 2836 - protein, 15 aa, Artificial Sequence
  Synthetically generated peptide
  misc_feature (3)..(3): Xaa can be Cys or D-Cys
AKXCEFCCNPACTGC

SEQ ID NO: 2837 - protein, 16 aa, Artificial Sequence
  Synthetically generated peptide
  misc_feature (3)..(3): Xaa can be Cys or D-Cys
AKXCEFCCNPACTGCK

SEQ ID NO: 2838 - protein, 16 aa, Artificial Sequence
  Synthetically generated peptide
  misc_feature (3)..(3): Xaa can be Cys or D-Cys
AKXCEFCCNPACTGCY

SEQ ID NO: 2839 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AKXCEFCCNPACTGX

SEQ ID NO: 2840 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AKXCEFCCNPACTGXK

SEQ ID NO: 2841 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AKXCEFCCNPACTGXY

SEQ ID NO: 2842 - protein, 15 aa, Artificial Sequence
  Synthetically generated peptide
  misc_feature (3)..(3): Xaa can be Cys or D-Cys
AKXCEFCCTPACTGC

SEQ ID NO: 2843 - protein, 16 aa, Artificial Sequence
  Synthetically generated peptide
  misc_feature (3)..(3): Xaa can be Cys or D-Cys
AKXCEFCCTPACTGCK

SEQ ID NO: 2844 - protein, 16 aa, Artificial Sequence
  Synthetically generated peptide
  misc_feature (3)..(3): Xaa can be Cys or D-Cys
AKXCEFCCTPACTGCY

SEQ ID NO: 2845 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AKXCEFCCTPACTGX

SEQ ID NO: 2846 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AKXCEFCCTPACTGXK

SEQ ID NO: 2847 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AKXCEFCCTPACTGXY

SEQ ID NO: 2848 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AKXCEFXCNPACTGC

SEQ ID NO: 2849 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AKXCEFXCNPACTGCK

SEQ ID NO: 2850 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AKXCEFXCNPACTGCY

SEQ ID NO: 2851 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCEFXCNPACTGX

SEQ ID NO: 2852 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCEFXCNPACTGXK

SEQ ID NO: 2853 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCEFXCNPACTGXY

SEQ ID NO: 2854 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AKXCEFXCTPACTGC

SEQ ID NO: 2855 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AKXCEFXCTPACTGCK

SEQ ID NO: 2856 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AKXCEFXCTPACTGCY

SEQ ID NO: 2857 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCEFXCTPACTGX

SEQ ID NO: 2858 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCEFXCTPACTGXK

SEQ ID NO: 2859 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCEFXCTPACTGXY

SEQ ID NO: 2860 - protein, 15 aa, Artificial Sequence
  Synthetically generated peptide
  misc_feature (3)..(3): Xaa can be Cys or D-Cys
AKXCEWCCNPACTGC

SEQ ID NO: 2861 - protein, 16 aa, Artificial Sequence
  Synthetically generated peptide
  misc_feature (3)..(3): Xaa can be Cys or D-Cys
AKXCEWCCNPACTGCK

SEQ ID NO: 2862 - protein, 16 aa, Artificial Sequence
  Synthetically generated peptide
  misc_feature (3)..(3): Xaa can be Cys or D-Cys
AKXCEWCCNPACTGCY

SEQ ID NO: 2863 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AKXCEWCCNPACTGX

SEQ ID NO: 2864 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AKXCEWCCNPACTGXK

SEQ ID NO: 2865 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AKXCEWCCNPACTGXY

SEQ ID NO: 2866 - protein, 15 aa, Artificial Sequence
  Synthetically generated peptide
  misc_feature (3)..(3): Xaa can be Cys or D-Cys
AKXCEWCCTPACTGC

SEQ ID NO: 2867 - protein, 16 aa, Artificial Sequence
  Synthetically generated peptide
  misc_feature (3)..(3): Xaa can be Cys or D-Cys
AKXCEWCCTPACTGCK

SEQ ID NO: 2868 - protein, 16 aa, Artificial Sequence
  Synthetically generated peptide
  misc_feature (3)..(3): Xaa can be Cys or D-Cys
AKXCEWCCTPACTGCY

SEQ ID NO: 2869 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AKXCEWCCTPACTGX

SEQ ID NO: 2870 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AKXCEWCCTPACTGXK

SEQ ID NO: 2871 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AKXCEWCCTPACTGXY

SEQ ID NO: 2872 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AKXCEWXCNPACTGC

SEQ ID NO: 2873 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AKXCEWXCNPACTGCK

SEQ ID NO: 2874 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AKXCEWXCNPACTGCY

SEQ ID NO: 2875 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCEWXCNPACTGX

SEQ ID NO: 2876 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCEWXCNPACTGXK

SEQ ID NO: 2877 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCEWXCNPACTGXY

SEQ ID NO: 2878 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AKXCEWXCTPACTGC

SEQ ID NO: 2879 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AKXCEWXCTPACTGCK

SEQ ID NO: 2880 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AKXCEWXCTPACTGCY

SEQ ID NO: 2881 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCEWXCTPACTGX

SEQ ID NO: 2882 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCEWXCTPACTGXK

SEQ ID NO: 2883 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AKXCEWXCTPACTGXY

SEQ ID NO: 2884 - protein, 15 aa, Artificial Sequence
  Synthetically generated peptide
ASCCEVCCNPACTGC

SEQ ID NO: 2885 - protein, 16 aa, Artificial Sequence
  Synthetically generated peptide
ASCCEVCCNPACTGCK

SEQ ID NO: 2886 - protein, 16 aa, Artificial Sequence
  Synthetically generated peptide
ASCCEVCCNPACTGCY

SEQ ID NO: 2887 - protein, 15 aa, Artificial Sequence
  Synthetically generated peptide
  misc_feature (15)..(15): Xaa can be Cys or D-Cys
ASCCEVCCNPACTGX

SEQ ID NO: 2888 - protein, 16 aa, Artificial Sequence
  Synthetically generated peptide
  misc_feature (15)..(15): Xaa can be Cys or D-Cys
ASCCEVCCNPACTGXK

SEQ ID NO: 2889 - protein, 16 aa, Artificial Sequence
  Synthetically generated peptide
  misc_feature (15)..(15): Xaa can be Cys or D-Cys
ASCCEVCCNPACTGXY

SEQ ID NO: 2890 - protein, 15 aa, Artificial Sequence
  Synthetically generated peptide
ASCCEVCCTPACTGC

SEQ ID NO: 2891 - protein, 16 aa, Artificial Sequence
  Synthetically generated peptide
ASCCEVCCTPACTGCK

SEQ ID NO: 2892 - protein, 16 aa, Artificial Sequence
  Synthetically generated peptide
ASCCEVCCTPACTGCY

SEQ ID NO: 2893 - protein, 15 aa, Artificial Sequence
  Synthetically generated peptide
  misc_feature (15)..(15): Xaa can be Cys or D-Cys
ASCCEVCCTPACTGX

SEQ ID NO: 2894 - protein, 16 aa, Artificial Sequence
  Synthetically generated peptide
  misc_feature (15)..(15): Xaa can be Cys or D-Cys
ASCCEVCCTPACTGXK

SEQ ID NO: 2895 - protein, 16 aa, Artificial Sequence
  Synthetically generated peptide
  misc_feature (15)..(15): Xaa can be Cys or D-Cys
ASCCEVCCTPACTGXY

SEQ ID NO: 2896 - protein, 15 aa, Artificial Sequence
  Synthetically generated peptide
  misc_feature (7)..(7): Xaa can be Cys or D-Cys
ASCCEVXCNPACTGC

SEQ ID NO: 2897 - protein, 16 aa, Artificial Sequence
  Synthetically generated peptide
  misc_feature (7)..(7): Xaa can be Cys or D-Cys
ASCCEVXCNPACTGCK

SEQ ID NO: 2898 - protein, 16 aa, Artificial Sequence
  Synthetically generated peptide
  misc_feature (7)..(7): Xaa can be Cys or D-Cys
ASCCEVXCNPACTGCY

SEQ ID NO: 2899 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
ASCCEVXCNPACTGX

SEQ ID NO: 2900 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
ASCCEVXCNPACTGXK

SEQ ID NO: 2901 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
ASCCEVXCNPACTGXY

SEQ ID NO: 2902 - protein, 15 aa, Artificial Sequence
  Synthetically generated peptide
  misc_feature (7)..(7): Xaa can be Cys or D-Cys
ASCCEVXCTPACTGC

SEQ ID NO: 2903 - protein, 16 aa, Artificial Sequence
  Synthetically generated peptide
  misc_feature (7)..(7): Xaa can be Cys or D-Cys
ASCCEVXCTPACTGCK

SEQ ID NO: 2904 - protein, 16 aa, Artificial Sequence
  Synthetically generated peptide
  misc_feature (7)..(7): Xaa can be Cys or D-Cys
ASCCEVXCTPACTGCY

SEQ ID NO: 2905 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
ASCCEVXCTPACTGX

SEQ ID NO: 2906 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
ASCCEVXCTPACTGXK

SEQ ID NO: 2907 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
ASCCEVXCTPACTGXY

SEQ ID NO: 2908 - protein, 15 aa, Artificial Sequence
  Synthetically generated peptide
ASCCEICCNPACTGC

SEQ ID NO: 2909 - protein, 16 aa, Artificial Sequence
  Synthetically generated peptide
ASCCEICCNPACTGCK

SEQ ID NO: 2910 - protein, 16 aa, Artificial Sequence
  Synthetically generated peptide
ASCCEICCNPACTGCY

SEQ ID NO: 2911 - protein, 15 aa, Artificial Sequence
  Synthetically generated peptide
  misc_feature (15)..(15): Xaa can be Cys or D-Cys
ASCCEICCNPACTGX

SEQ ID NO: 2912 - protein, 16 aa, Artificial Sequence
  Synthetically generated peptide
  misc_feature (15)..(15): Xaa can be Cys or D-Cys
ASCCEICCNPACTGXK

SEQ ID NO: 2913 - protein, 16 aa, Artificial Sequence
  Synthetically generated peptide
  misc_feature (15)..(15): Xaa can be Cys or D-Cys
ASCCEICCNPACTGXY

SEQ ID NO: 2914 - protein, 15 aa, Artificial Sequence
  Synthetically generated peptide
ASCCEICCTPACTGC

SEQ ID NO: 2915 - protein, 16 aa, Artificial Sequence
  Synthetically generated peptide
ASCCEICCTPACTGCK

SEQ ID NO: 2916 - protein, 16 aa, Artificial Sequence
  Synthetically generated peptide
ASCCEICCTPACTGCY

SEQ ID NO: 2917 - protein, 15 aa, Artificial Sequence
  Synthetically generated peptide
  misc_feature (15)..(15): Xaa can be Cys or D-Cys
ASCCEICCTPACTGX

SEQ ID NO: 2918 - protein, 16 aa, Artificial Sequence
  Synthetically generated peptide
  misc_feature (15)..(15): Xaa can be Cys or D-Cys
ASCCEICCTPACTGXK

SEQ ID NO: 2919 - protein, 16 aa, Artificial Sequence
  Synthetically generated peptide
  misc_feature (15)..(15): Xaa can be Cys or D-Cys
ASCCEICCTPACTGXY

SEQ ID NO: 2920 - protein, 15 aa, Artificial Sequence
  Synthetically generated peptide
  misc_feature (7)..(7): Xaa can be Cys or D-Cys
ASCCEIXCNPACTGC

SEQ ID NO: 2921 - protein, 16 aa, Artificial Sequence
  Synthetically generated peptide
  misc_feature (7)..(7): Xaa can be Cys or D-Cys
ASCCEIXCNPACTGCK

SEQ ID NO: 2922 - protein, 16 aa, Artificial Sequence
  Synthetically generated peptide
  misc_feature (7)..(7): Xaa can be Cys or D-Cys
ASCCEIXCNPACTGCY

SEQ ID NO: 2923 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
ASCCEIXCNPACTGX

SEQ ID NO: 2924 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
ASCCEIXCNPACTGXK

SEQ ID NO: 2925 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
ASCCEIXCNPACTGXY

SEQ ID NO: 2926 - protein, 15 aa, Artificial Sequence
  Synthetically generated peptide
  misc_feature (7)..(7): Xaa can be Cys or D-Cys
ASCCEIXCTPACTGC

SEQ ID NO: 2927 - protein, 16 aa, Artificial Sequence
  Synthetically generated peptide
  misc_feature (7)..(7): Xaa can be Cys or D-Cys
ASCCEIXCTPACTGCK

SEQ ID NO: 2928 - protein, 16 aa, Artificial Sequence
  Synthetically generated peptide
  misc_feature (7)..(7): Xaa can be Cys or D-Cys
ASCCEIXCTPACTGCY

SEQ ID NO: 2929 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
ASCCEIXCTPACTGX

SEQ ID NO: 2930 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
ASCCEIXCTPACTGXK

SEQ ID NO: 2931 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
ASCCEIXCTPACTGXY

SEQ ID NO: 2932 - protein, 15 aa, Artificial Sequence
  Synthetically generated peptide
ASCCELCCNPACTGC

SEQ ID NO: 2933 - protein, 16 aa, Artificial Sequence
  Synthetically generated peptide
ASCCELCCNPACTGCK

SEQ ID NO: 2934 - protein, 16 aa, Artificial Sequence
  Synthetically generated peptide
ASCCELCCNPACTGCY

SEQ ID NO: 2935 - protein, 15 aa, Artificial Sequence
  Synthetically generated peptide
  misc_feature (15)..(15): Xaa can be Cys or D-Cys
ASCCELCCNPACTGX

SEQ ID NO: 2936 - protein, 16 aa, Artificial Sequence
  Synthetically generated peptide
  misc_feature (15)..(15): Xaa can be Cys or D-Cys
ASCCELCCNPACTGXK

SEQ ID NO: 2937 - protein, 16 aa, Artificial Sequence
  Synthetically generated peptide
  misc_feature (15)..(15): Xaa can be Cys or D-Cys
ASCCELCCNPACTGXY

SEQ ID NO: 2938 - protein, 15 aa, Artificial Sequence
  Synthetically generated peptide
ASCCELCCTPACTGC

SEQ ID NO: 2939 - protein, 16 aa, Artificial Sequence
  Synthetically generated peptide
ASCCELCCTPACTGCK

SEQ ID NO: 2940 - protein, 16 aa, Artificial Sequence
  Synthetically generated peptide
ASCCELCCTPACTGCY

SEQ ID NO: 2941 - protein, 15 aa, Artificial Sequence
  Synthetically generated peptide
  misc_feature (15)..(15): Xaa can be Cys or D-Cys
ASCCELCCTPACTGX

SEQ ID NO: 2942 - protein, 16 aa, Artificial Sequence
  Synthetically generated peptide
  misc_feature (15)..(15): Xaa can be Cys or D-Cys
ASCCELCCTPACTGXK

SEQ ID NO: 2943 - protein, 16 aa, Artificial Sequence
  Synthetically generated peptide
  misc_feature (15)..(15): Xaa can be Cys or D-Cys
ASCCELCCTPACTGXY

SEQ ID NO: 2944 - protein, 15 aa, Artificial Sequence
  Synthetically generated peptide
  misc_feature (7)..(7): Xaa can be Cys or D-Cys
ASCCELXCNPACTGC

SEQ ID NO: 2945 - protein, 16 aa, Artificial Sequence
  Synthetically generated peptide
  misc_feature (7)..(7): Xaa can be Cys or D-Cys
ASCCELXCNPACTGCK

SEQ ID NO: 2946 - protein, 16 aa, Artificial Sequence
  Synthetically generated peptide
  misc_feature (7)..(7): Xaa can be Cys or D-Cys
ASCCELXCNPACTGCY

SEQ ID NO: 2947 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
ASCCELXCNPACTGX

SEQ ID NO: 2948 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
ASCCELXCNPACTGXK

SEQ ID NO: 2949 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
ASCCELXCNPACTGXY

SEQ ID NO: 2950 - protein, 15 aa, Artificial Sequence
  Synthetically generated peptide
  misc_feature (7)..(7): Xaa can be Cys or D-Cys
ASCCELXCTPACTGC

SEQ ID NO: 2951 - protein, 16 aa, Artificial Sequence
  Synthetically generated peptide
  misc_feature (7)..(7): Xaa can be Cys or D-Cys
ASCCELXCTPACTGCK

SEQ ID NO: 2952 - protein, 16 aa, Artificial Sequence
  Synthetically generated peptide
  misc_feature (7)..(7): Xaa can be Cys or D-Cys
ASCCELXCTPACTGCY

SEQ ID NO: 2953 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
ASCCELXCTPACTGX

SEQ ID NO: 2954 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
ASCCELXCTPACTGXK

SEQ ID NO: 2955 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
ASCCELXCTPACTGXY

SEQ ID NO: 2956 - protein, 15 aa, Artificial Sequence
  Synthetically generated peptide
ASCCEYCCNPACTGC

SEQ ID NO: 2957 - protein, 16 aa, Artificial Sequence
  Synthetically generated peptide
ASCCEYCCNPACTGCK

SEQ ID NO: 2958 - protein, 16 aa, Artificial Sequence
  Synthetically generated peptide
ASCCEYCCNPACTGCY

SEQ ID NO: 2959 - protein, 15 aa, Artificial Sequence
  Synthetically generated peptide
  misc_feature (15)..(15): Xaa can be Cys or D-Cys
ASCCEYCCNPACTGX

SEQ ID NO: 2960 - protein, 16 aa, Artificial Sequence
  Synthetically generated peptide
  misc_feature (15)..(15): Xaa can be Cys or D-Cys
ASCCEYCCNPACTGXK

SEQ ID NO: 2961 - protein, 16 aa, Artificial Sequence
  Synthetically generated peptide
  misc_feature (15)..(15): Xaa can be Cys or D-Cys
ASCCEYCCNPACTGXY

SEQ ID NO: 2962 - protein, 15 aa, Artificial Sequence
  Synthetically generated peptide
ASCCEYCCTPACTGC

SEQ ID NO: 2963 - protein, 16 aa, Artificial Sequence
  Synthetically generated peptide
ASCCEYCCTPACTGCK

SEQ ID NO: 2964 - protein, 16 aa, Artificial Sequence
  Synthetically generated peptide
ASCCEYCCTPACTGCY

SEQ ID NO: 2965 - protein, 15 aa, Artificial Sequence
  Synthetically generated peptide
  misc_feature (15)..(15): Xaa can be Cys or D-Cys
ASCCEYCCTPACTGX

SEQ ID NO: 2966 - protein, 16 aa, Artificial Sequence
  Synthetically generated peptide
  misc_feature (15)..(15): Xaa can be Cys or D-Cys
ASCCEYCCTPACTGXK

SEQ ID NO: 2967 - protein, 16 aa, Artificial Sequence
  Synthetically generated peptide
  misc_feature (15)..(15): Xaa can be Cys or D-Cys
ASCCEYCCTPACTGXY

SEQ ID NO: 2968 - protein, 15 aa, Artificial Sequence
  Synthetically generated peptide
  misc_feature (7)..(7): Xaa can be Cys or D-Cys
ASCCEYXCNPACTGC

SEQ ID NO: 2969 - protein, 16 aa, Artificial Sequence
  Synthetically generated peptide
  misc_feature (7)..(7): Xaa can be Cys or D-Cys
ASCCEYXCNPACTGCK

SEQ ID NO: 2970 - protein, 16 aa, Artificial Sequence
  Synthetically generated peptide
  misc_feature (7)..(7): Xaa can be Cys or D-Cys
ASCCEYXCNPACTGCY

SEQ ID NO: 2971 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
ASCCEYXCNPACTGX

SEQ ID NO: 2972 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
ASCCEYXCNPACTGXK

SEQ ID NO: 2973 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
ASCCEYXCNPACTGXY

SEQ ID NO: 2974 - protein, 15 aa, Artificial Sequence
  Synthetically generated peptide
  misc_feature (7)..(7): Xaa can be Cys or D-Cys
ASCCEYXCTPACTGC

SEQ ID NO: 2975 - protein, 16 aa, Artificial Sequence
  Synthetically generated peptide
  misc_feature (7)..(7): Xaa can be Cys or D-Cys
ASCCEYXCTPACTGCK

SEQ ID NO: 2976 - protein, 16 aa, Artificial Sequence
  Synthetically generated peptide
  misc_feature (7)..(7): Xaa can be Cys or D-Cys
ASCCEYXCTPACTGCY

SEQ ID NO: 2977 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
ASCCEYXCTPACTGX

SEQ ID NO: 2978 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
ASCCEYXCTPACTGXK

SEQ ID NO: 2979 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
ASCCEYXCTPACTGXY

SEQ ID NO: 2980 - protein, 15 aa, Artificial Sequence
  Synthetically generated peptide
ASCCEFCCNPACTGC

SEQ ID NO: 2981 - protein, 16 aa, Artificial Sequence
  Synthetically generated peptide
ASCCEFCCNPACTGCK

SEQ ID NO: 2982 - protein, 16 aa, Artificial Sequence
  Synthetically generated peptide
ASCCEFCCNPACTGCY

SEQ ID NO: 2983 - protein, 15 aa, Artificial Sequence
  Synthetically generated peptide
  misc_feature (15)..(15): Xaa can be Cys or D-Cys
ASCCEFCCNPACTGX

SEQ ID NO: 2984 - protein, 16 aa, Artificial Sequence
  Synthetically generated peptide
  misc_feature (15)..(15): Xaa can be Cys or D-Cys
ASCCEFCCNPACTGXK

SEQ ID NO: 2985 - protein, 16 aa, Artificial Sequence
  Synthetically generated peptide
  misc_feature (15)..(15): Xaa can be Cys or D-Cys
ASCCEFCCNPACTGXY

SEQ ID NO: 2986 - protein, 15 aa, Artificial Sequence
  Synthetically generated peptide
ASCCEFCCTPACTGC

SEQ ID NO: 2987 - protein, 16 aa, Artificial Sequence
  Synthetically generated peptide
ASCCEFCCTPACTGCK

SEQ ID NO: 2988 - protein, 16 aa, Artificial Sequence
  Synthetically generated peptide
ASCCEFCCTPACTGCY

SEQ ID NO: 2989 - protein, 15 aa, Artificial Sequence
  Synthetically generated peptide
  misc_feature (15)..(15): Xaa can be Cys or D-Cys
ASCCEFCCTPACTGX

SEQ ID NO: 2990 - protein, 16 aa, Artificial Sequence
  Synthetically generated peptide
  misc_feature (15)..(15): Xaa can be Cys or D-Cys
ASCCEFCCTPACTGXK

SEQ ID NO: 2991 - protein, 16 aa, Artificial Sequence
  Synthetically generated peptide
  misc_feature (15)..(15): Xaa can be Cys or D-Cys
ASCCEFCCTPACTGXY

SEQ ID NO: 2992 - protein, 15 aa, Artificial Sequence
  Synthetically generated peptide
  misc_feature (7)..(7): Xaa can be Cys or D-Cys
ASCCEFXCNPACTGC

SEQ ID NO: 2993 - protein, 16 aa, Artificial Sequence
  Synthetically generated peptide
  misc_feature (7)..(7): Xaa can be Cys or D-Cys
ASCCEFXCNPACTGCK

SEQ ID NO: 2994 - protein, 16 aa, Artificial Sequence
  Synthetically generated peptide
  misc_feature (7)..(7): Xaa can be Cys or D-Cys
ASCCEFXCNPACTGCY

SEQ ID NO: 2995 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
ASCCEFXCNPACTGX

SEQ ID NO: 2996 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
ASCCEFXCNPACTGXK

SEQ ID NO: 2997 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
ASCCEFXCNPACTGXY

SEQ ID NO: 2998 - protein, 15 aa, Artificial Sequence
  Synthetically generated peptide
  misc_feature (7)..(7): Xaa can be Cys or D-Cys
ASCCEFXCTPACTGC

SEQ ID NO: 2999 - protein, 16 aa, Artificial Sequence
  Synthetically generated peptide
  misc_feature (7)..(7): Xaa can be Cys or D-Cys
ASCCEFXCTPACTGCK

SEQ ID NO: 3000 - protein, 16 aa, Artificial Sequence
  Synthetically generated peptide
  misc_feature (7)..(7): Xaa can be Cys or D-Cys
ASCCEFXCTPACTGCY

SEQ ID NO: 3001 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
ASCCEFXCTPACTGX

SEQ ID NO: 3002 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
ASCCEFXCTPACTGXK

SEQ ID NO: 3003 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
ASCCEFXCTPACTGXY

SEQ ID NO: 3004 - protein, 15 aa, Artificial Sequence
  Synthetically generated peptide
ASCCEWCCNPACTGC

SEQ ID NO: 3005 - protein, 16 aa, Artificial Sequence
  Synthetically generated peptide
ASCCEWCCNPACTGCK

SEQ ID NO: 3006 - protein, 16 aa, Artificial Sequence
  Synthetically generated peptide
ASCCEWCCNPACTGCY

SEQ ID NO: 3007 - protein, 15 aa, Artificial Sequence
  Synthetically generated peptide
  misc_feature (15)..(15): Xaa can be Cys or D-Cys
ASCCEWCCNPACTGX

SEQ ID NO: 3008 - protein, 16 aa, Artificial Sequence
  Synthetically generated peptide
  misc_feature (15)..(15): Xaa can be Cys or D-Cys
ASCCEWCCNPACTGXK

SEQ ID NO: 3009 - protein, 16 aa, Artificial Sequence
  Synthetically generated peptide
  misc_feature (15)..(15): Xaa can be Cys or D-Cys
ASCCEWCCNPACTGXY

SEQ ID NO: 3010 - protein, 15 aa, Artificial Sequence
  Synthetically generated peptide
ASCCEWCCTPACTGC

SEQ ID NO: 3011 - protein, 16 aa, Artificial Sequence
  Synthetically generated peptide
ASCCEWCCTPACTGCK

SEQ ID NO: 3012 - protein, 16 aa, Artificial Sequence
  Synthetically generated peptide
ASCCEWCCTPACTGCY

SEQ ID NO: 3013 - protein, 15 aa, Artificial Sequence
  Synthetically generated peptide
  misc_feature (15)..(15): Xaa can be Cys or D-Cys
ASCCEWCCTPACTGX

SEQ ID NO: 3014 - protein, 16 aa, Artificial Sequence
  Synthetically generated peptide
  misc_feature (15)..(15): Xaa can be Cys or D-Cys
ASCCEWCCTPACTGXK

SEQ ID NO: 3015 - protein, 16 aa, Artificial Sequence
  Synthetically generated peptide
  misc_feature (15)..(15): Xaa can be Cys or D-Cys
ASCCEWCCTPACTGXY

SEQ ID NO: 3016 - protein, 15 aa, Artificial Sequence
  Synthetically generated peptide
  misc_feature (7)..(7): Xaa can be Cys or D-Cys
ASCCEWXCNPACTGC

SEQ ID NO: 3017 - protein, 16 aa, Artificial Sequence
  Synthetically generated peptide
  misc_feature (7)..(7): Xaa can be Cys or D-Cys
ASCCEWXCNPACTGCK

SEQ ID NO: 3018 - protein, 16 aa, Artificial Sequence
  Synthetically generated peptide
  misc_feature (7)..(7): Xaa can be Cys or D-Cys
ASCCEWXCNPACTGCY

SEQ ID NO: 3019 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
ASCCEWXCNPACTGX

SEQ ID NO: 3020 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
ASCCEWXCNPACTGXK

SEQ ID NO: 3021 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
ASCCEWXCNPACTGXY

SEQ ID NO: 3022 - protein, 15 aa, Artificial Sequence
  Synthetically generated peptide
  misc_feature (7)..(7): Xaa can be Cys or D-Cys
ASCCEWXCTPACTGC

SEQ ID NO: 3023 - protein, 16 aa, Artificial Sequence
  Synthetically generated peptide
  misc_feature (7)..(7): Xaa can be Cys or D-Cys
ASCCEWXCTPACTGCK

SEQ ID NO: 3024 - protein, 16 aa, Artificial Sequence
  Synthetically generated peptide
  misc_feature (7)..(7): Xaa can be Cys or D-Cys
ASCCEWXCTPACTGCY

SEQ ID NO: 3025 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
ASCCEWXCTPACTGX

SEQ ID NO: 3026 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
ASCCEWXCTPACTGXK

SEQ ID NO: 3027 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
ASCCEWXCTPACTGXY

SEQ ID NO: 3028 - protein, 15 aa, Artificial Sequence
  Synthetically generated peptide
  misc_feature (3)..(3): Xaa can be Cys or D-Cys
ASXCEVCCNPACTGC

SEQ ID NO: 3029 - protein, 16 aa, Artificial Sequence
  Synthetically generated peptide
  misc_feature (3)..(3): Xaa can be Cys or D-Cys
ASXCEVCCNPACTGCK

SEQ ID NO: 3030 - protein, 16 aa, Artificial Sequence
  Synthetically generated peptide
  misc_feature (3)..(3): Xaa can be Cys or D-Cys
ASXCEVCCNPACTGCY

SEQ ID NO: 3031 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
ASXCEVCCNPACTGX

SEQ ID NO: 3032 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
ASXCEVCCNPACTGXK

SEQ ID NO: 3033 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
ASXCEVCCNPACTGXY

SEQ ID NO: 3034 - protein, 15 aa, Artificial Sequence
  Synthetically generated peptide
  misc_feature (3)..(3): Xaa can be Cys or D-Cys
ASXCEVCCTPACTGC

SEQ ID NO: 3035 - protein, 16 aa, Artificial Sequence
  Synthetically generated peptide
  misc_feature (3)..(3): Xaa can be Cys or D-Cys
ASXCEVCCTPACTGCK

SEQ ID NO: 3036 - protein, 16 aa, Artificial Sequence
  Synthetically generated peptide
  misc_feature (3)..(3): Xaa can be Cys or D-Cys
ASXCEVCCTPACTGCY

SEQ ID NO: 3037 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
ASXCEVCCTPACTGX

SEQ ID NO: 3038 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
ASXCEVCCTPACTGXK

SEQ ID NO: 3039 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
ASXCEVCCTPACTGXY

SEQ ID NO: 3040 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
ASXCEVXCNPACTGC

SEQ ID NO: 3041 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
ASXCEVXCNPACTGCK

SEQ ID NO: 3042 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
ASXCEVXCNPACTGCY

SEQ ID NO: 3043 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCEVXCNPACTGX

SEQ ID NO: 3044 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCEVXCNPACTGXK

SEQ ID NO: 3045 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCEVXCNPACTGXY

SEQ ID NO: 3046 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
ASXCEVXCTPACTGC

SEQ ID NO: 3047 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
ASXCEVXCTPACTGCK

SEQ ID NO: 3048 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
ASXCEVXCTPACTGCY

SEQ ID NO: 3049 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCEVXCTPACTGX

SEQ ID NO: 3050 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCEVXCTPACTGXK

SEQ ID NO: 3051 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCEVXCTPACTGXY

SEQ ID NO: 3052 - protein, 15 aa, Artificial Sequence
  Synthetically generated peptide
  misc_feature (3)..(3): Xaa can be Cys or D-Cys
ASXCEICCNPACTGC

SEQ ID NO: 3053 - protein, 16 aa, Artificial Sequence
  Synthetically generated peptide
  misc_feature (3)..(3): Xaa can be Cys or D-Cys
ASXCEICCNPACTGCK

SEQ ID NO: 3054 - protein, 16 aa, Artificial Sequence
  Synthetically generated peptide
  misc_feature (3)..(3): Xaa can be Cys or D-Cys
ASXCEICCNPACTGCY

SEQ ID NO: 3055 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
ASXCEICCNPACTGX

SEQ ID NO: 3056 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
ASXCEICCNPACTGXK

SEQ ID NO: 3057 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
ASXCEICCNPACTGXY

SEQ ID NO: 3058 - protein, 15 aa, Artificial Sequence
  Synthetically generated peptide
  misc_feature (3)..(3): Xaa can be Cys or D-Cys
ASXCEICCTPACTGC

SEQ ID NO: 3059 - protein, 16 aa, Artificial Sequence
  Synthetically generated peptide
  misc_feature (3)..(3): Xaa can be Cys or D-Cys
ASXCEICCTPACTGCK

SEQ ID NO: 3060 - protein, 16 aa, Artificial Sequence
  Synthetically generated peptide
  misc_feature (3)..(3): Xaa can be Cys or D-Cys
ASXCEICCTPACTGCY

SEQ ID NO: 3061 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
ASXCEICCTPACTGX

SEQ ID NO: 3062 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
ASXCEICCTPACTGXK

SEQ ID NO: 3063 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
ASXCEICCTPACTGXY

SEQ ID NO: 3064 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
ASXCEIXCNPACTGC

SEQ ID NO: 3065 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
ASXCEIXCNPACTGCK

SEQ ID NO: 3066 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
ASXCEIXCNPACTGCY

SEQ ID NO: 3067 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCEIXCNPACTGX

SEQ ID NO: 3068 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCEIXCNPACTGXK

SEQ ID NO: 3069 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCEIXCNPACTGXY

SEQ ID NO: 3070 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
ASXCEIXCTPACTGC

SEQ ID NO: 3071 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
ASXCEIXCTPACTGCK

SEQ ID NO: 3072 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
ASXCEIXCTPACTGCY

SEQ ID NO: 3073 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCEIXCTPACTGX

SEQ ID NO: 3074 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCEIXCTPACTGXK

SEQ ID NO: 3075 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCEIXCTPACTGXY

SEQ ID NO: 3076 - protein, 15 aa, Artificial Sequence
  Synthetically generated peptide
  misc_feature (3)..(3): Xaa can be Cys or D-Cys
ASXCELCCNPACTGC

SEQ ID NO: 3077 - protein, 16 aa, Artificial Sequence
  Synthetically generated peptide
  misc_feature (3)..(3): Xaa can be Cys or D-Cys
ASXCELCCNPACTGCK

SEQ ID NO: 3078 - protein, 16 aa, Artificial Sequence
  Synthetically generated peptide
  misc_feature (3)..(3): Xaa can be Cys or D-Cys
ASXCELCCNPACTGCY

SEQ ID NO: 3079 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
ASXCELCCNPACTGX

SEQ ID NO: 3080 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
ASXCELCCNPACTGXK

SEQ ID NO: 3081 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
ASXCELCCNPACTGXY

SEQ ID NO: 3082 - protein, 15 aa, Artificial Sequence
  Synthetically generated peptide
  misc_feature (3)..(3): Xaa can be Cys or D-Cys
ASXCELCCTPACTGC

SEQ ID NO: 3083 - protein, 16 aa, Artificial Sequence
  Synthetically generated peptide
  misc_feature (3)..(3): Xaa can be Cys or D-Cys
ASXCELCCTPACTGCK

SEQ ID NO: 3084 - protein, 16 aa, Artificial Sequence
  Synthetically generated peptide
  misc_feature (3)..(3): Xaa can be Cys or D-Cys
ASXCELCCTPACTGCY

SEQ ID NO: 3085 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
ASXCELCCTPACTGX

SEQ ID NO: 3086 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
ASXCELCCTPACTGXK

SEQ ID NO: 3087 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
ASXCELCCTPACTGXY

SEQ ID NO: 3088 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
ASXCELXCNPACTGC

SEQ ID NO: 3089 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
ASXCELXCNPACTGCK

SEQ ID NO: 3090 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
ASXCELXCNPACTGCY

SEQ ID NO: 3091 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCELXCNPACTGX

SEQ ID NO: 3092 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCELXCNPACTGXK

SEQ ID NO: 3093 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCELXCNPACTGXY

SEQ ID NO: 3094 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
ASXCELXCTPACTGC

SEQ ID NO: 3095 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
ASXCELXCTPACTGCK

SEQ ID NO: 3096 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
ASXCELXCTPACTGCY

SEQ ID NO: 3097 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCELXCTPACTGX

SEQ ID NO: 3098 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCELXCTPACTGXK

SEQ ID NO: 3099 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCELXCTPACTGXY

SEQ ID NO: 3100 - protein, 15 aa, Artificial Sequence
  Synthetically generated peptide
  misc_feature (3)..(3): Xaa can be Cys or D-Cys
ASXCEYCCNPACTGC

SEQ ID NO: 3101 - protein, 16 aa, Artificial Sequence
  Synthetically generated peptide
  misc_feature (3)..(3): Xaa can be Cys or D-Cys
ASXCEYCCNPACTGCK

SEQ ID NO: 3102 - protein, 16 aa, Artificial Sequence
  Synthetically generated peptide
  misc_feature (3)..(3): Xaa can be Cys or D-Cys
ASXCEYCCNPACTGCY

SEQ ID NO: 3103 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
ASXCEYCCNPACTGX

SEQ ID NO: 3104 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
ASXCEYCCNPACTGXK

SEQ ID NO: 3105 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
ASXCEYCCNPACTGXY

SEQ ID NO: 3106 - protein, 15 aa, Artificial Sequence
  Synthetically generated peptide
  misc_feature (3)..(3): Xaa can be Cys or D-Cys
ASXCEYCCTPACTGC

SEQ ID NO: 3107 - protein, 16 aa, Artificial Sequence
  Synthetically generated peptide
  misc_feature (3)..(3): Xaa can be Cys or D-Cys
ASXCEYCCTPACTGCK

SEQ ID NO: 3108 - protein, 16 aa, Artificial Sequence
  Synthetically generated peptide
  misc_feature (3)..(3): Xaa can be Cys or D-Cys
ASXCEYCCTPACTGCY

SEQ ID NO: 3109 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
ASXCEYCCTPACTGX

SEQ ID NO: 3110 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
ASXCEYCCTPACTGXK

SEQ ID NO: 3111 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
ASXCEYCCTPACTGXY

SEQ ID NO: 3112 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
ASXCEYXCNPACTGC

SEQ ID NO: 3113 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
ASXCEYXCNPACTGCK

SEQ ID NO: 3114 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
ASXCEYXCNPACTGCY

SEQ ID NO: 3115 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCEYXCNPACTGX

SEQ ID NO: 3116 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCEYXCNPACTGXK

SEQ ID NO: 3117 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCEYXCNPACTGXY

SEQ ID NO: 3118 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
ASXCEYXCTPACTGC

SEQ ID NO: 3119 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
ASXCEYXCTPACTGCK

SEQ ID NO: 3120 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
ASXCEYXCTPACTGCY

SEQ ID NO: 3121 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCEYXCTPACTGX

SEQ ID NO: 3122 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCEYXCTPACTGXK

SEQ ID NO: 3123 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCEYXCTPACTGXY

SEQ ID NO: 3124 - protein, 15 aa, Artificial Sequence
  Synthetically generated peptide
  misc_feature (3)..(3): Xaa can be Cys or D-Cys
ASXCEFCCNPACTGC

SEQ ID NO: 3125 - protein, 16 aa, Artificial Sequence
  Synthetically generated peptide
  misc_feature (3)..(3): Xaa can be Cys or D-Cys
ASXCEFCCNPACTGCK

SEQ ID NO: 3126 - protein, 16 aa, Artificial Sequence
  Synthetically generated peptide
  misc_feature (3)..(3): Xaa can be Cys or D-Cys
ASXCEFCCNPACTGCY

SEQ ID NO: 3127 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
ASXCEFCCNPACTGX

SEQ ID NO: 3128 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
ASXCEFCCNPACTGXK

SEQ ID NO: 3129 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
ASXCEFCCNPACTGXY

SEQ ID NO: 3130 - protein, 15 aa, Artificial Sequence
  Synthetically generated peptide
  misc_feature (3)..(3): Xaa can be Cys or D-Cys
ASXCEFCCTPACTGC

SEQ ID NO: 3131 - protein, 16 aa, Artificial Sequence
  Synthetically generated peptide
  misc_feature (3)..(3): Xaa can be Cys or D-Cys
ASXCEFCCTPACTGCK

SEQ ID NO: 3132 - protein, 16 aa, Artificial Sequence
  Synthetically generated peptide
  misc_feature (3)..(3): Xaa can be Cys or D-Cys
ASXCEFCCTPACTGCY

SEQ ID NO: 3133 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
ASXCEFCCTPACTGX

SEQ ID NO: 3134 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
ASXCEFCCTPACTGXK

SEQ ID NO: 3135 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
ASXCEFCCTPACTGXY

SEQ ID NO: 3136 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
ASXCEFXCNPACTGC

SEQ ID NO: 3137 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
ASXCEFXCNPACTGCK

SEQ ID NO: 3138 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
ASXCEFXCNPACTGCY

SEQ ID NO: 3139 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCEFXCNPACTGX

SEQ ID NO: 3140 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCEFXCNPACTGXK

SEQ ID NO: 3141 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCEFXCNPACTGXY

SEQ ID NO: 3142 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
ASXCEFXCTPACTGC

SEQ ID NO: 3143 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
ASXCEFXCTPACTGCK

SEQ ID NO: 3144 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
ASXCEFXCTPACTGCY

SEQ ID NO: 3145 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCEFXCTPACTGX

SEQ ID NO: 3146 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCEFXCTPACTGXK

SEQ ID NO: 3147 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCEFXCTPACTGXY

SEQ ID NO: 3148 - protein, 15 aa, Artificial Sequence
  Synthetically generated peptide
  misc_feature (3)..(3): Xaa can be Cys or D-Cys
ASXCEWCCNPACTGC

SEQ ID NO: 3149 - protein, 16 aa, Artificial Sequence
  Synthetically generated peptide
  misc_feature (3)..(3): Xaa can be Cys or D-Cys
ASXCEWCCNPACTGCK

SEQ ID NO: 3150 - protein, 16 aa, Artificial Sequence
  Synthetically generated peptide
  misc_feature (3)..(3): Xaa can be Cys or D-Cys
ASXCEWCCNPACTGCY

SEQ ID NO: 3151 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
ASXCEWCCNPACTGX

SEQ ID NO: 3152 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
ASXCEWCCNPACTGXK

SEQ ID NO: 3153 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
ASXCEWCCNPACTGXY

SEQ ID NO: 3154 - protein, 15 aa, Artificial Sequence
  Synthetically generated peptide
  misc_feature (3)..(3): Xaa can be Cys or D-Cys
ASXCEWCCTPACTGC

SEQ ID NO: 3155 - protein, 16 aa, Artificial Sequence
  Synthetically generated peptide
  misc_feature (3)..(3): Xaa can be Cys or D-Cys
ASXCEWCCTPACTGCK

SEQ ID NO: 3156 - protein, 16 aa, Artificial Sequence
  Synthetically generated peptide
  misc_feature (3)..(3): Xaa can be Cys or D-Cys
ASXCEWCCTPACTGCY

SEQ ID NO: 3157 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
ASXCEWCCTPACTGX

SEQ ID NO: 3158 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
ASXCEWCCTPACTGXK

SEQ ID NO: 3159 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
ASXCEWCCTPACTGXY

SEQ ID NO: 3160 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
ASXCEWXCNPACTGC

SEQ ID NO: 3161 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
ASXCEWXCNPACTGCK

SEQ ID NO: 3162 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
ASXCEWXCNPACTGCY

SEQ ID NO: 3163 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCEWXCNPACTGX

SEQ ID NO: 3164 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCEWXCNPACTGXK

SEQ ID NO: 3165 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCEWXCNPACTGXY

SEQ ID NO: 3166 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
ASXCEWXCTPACTGC

SEQ ID NO: 3167 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
ASXCEWXCTPACTGCK

SEQ ID NO: 3168 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
ASXCEWXCTPACTGCY

SEQ ID NO: 3169 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCEWXCTPACTGX

SEQ ID NO: 3170 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCEWXCTPACTGXK

SEQ ID NO: 3171 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
ASXCEWXCTPACTGXY

SEQ ID NO: 3172 - protein, 15 aa, Artificial Sequence
  Synthetically generated peptide
AVCCEVCCNPACTGC

SEQ ID NO: 3173 - protein, 16 aa, Artificial Sequence
  Synthetically generated peptide
AVCCEVCCNPACTGCK

SEQ ID NO: 3174 - protein, 16 aa, Artificial Sequence
  Synthetically generated peptide
AVCCEVCCNPACTGCY

SEQ ID NO: 3175 - protein, 15 aa, Artificial Sequence
  Synthetically generated peptide
  misc_feature (15)..(15): Xaa can be Cys or D-Cys
AVCCEVCCNPACTGX

SEQ ID NO: 3176 - protein, 16 aa, Artificial Sequence
  Synthetically generated peptide
  misc_feature (15)..(15): Xaa can be Cys or D-Cys
AVCCEVCCNPACTGXK

SEQ ID NO: 3177 - protein, 16 aa, Artificial Sequence
  Synthetically generated peptide
  misc_feature (15)..(15): Xaa can be Cys or D-Cys
AVCCEVCCNPACTGXY

SEQ ID NO: 3178 - protein, 15 aa, Artificial Sequence
  Synthetically generated peptide
AVCCEVCCTPACTGC

SEQ ID NO: 3179 - protein, 16 aa, Artificial Sequence
  Synthetically generated peptide
AVCCEVCCTPACTGCK

SEQ ID NO: 3180 - protein, 16 aa, Artificial Sequence
  Synthetically generated peptide
AVCCEVCCTPACTGCY

SEQ ID NO: 3181 - protein, 15 aa, Artificial Sequence
  Synthetically generated peptide
  misc_feature (15)..(15): Xaa can be Cys or D-Cys
AVCCEVCCTPACTGX

SEQ ID NO: 3182 - protein, 16 aa, Artificial Sequence
  Synthetically generated peptide
  misc_feature (15)..(15): Xaa can be Cys or D-Cys
AVCCEVCCTPACTGXK

SEQ ID NO: 3183 - protein, 16 aa, Artificial Sequence
  Synthetically generated peptide
  misc_feature (15)..(15): Xaa can be Cys or D-Cys
AVCCEVCCTPACTGXY

SEQ ID NO: 3184 - protein, 15 aa, Artificial Sequence
  Synthetically generated peptide
  misc_feature (7)..(7): Xaa can be Cys or D-Cys
AVCCEVXCNPACTGC

SEQ ID NO: 3185 - protein, 16 aa, Artificial Sequence
  Synthetically generated peptide
  misc_feature (7)..(7): Xaa can be Cys or D-Cys
AVCCEVXCNPACTGCK

SEQ ID NO: 3186 - protein, 16 aa, Artificial Sequence
  Synthetically generated peptide
  misc_feature (7)..(7): Xaa can be Cys or D-Cys
AVCCEVXCNPACTGCY

SEQ ID NO: 3187 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AVCCEVXCNPACTGX

SEQ ID NO: 3188 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AVCCEVXCNPACTGXK

SEQ ID NO: 3189 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AVCCEVXCNPACTGXY

SEQ ID NO: 3190 - protein, 15 aa, Artificial Sequence
  Synthetically generated peptide
  misc_feature (7)..(7): Xaa can be Cys or D-Cys
AVCCEVXCTPACTGC

SEQ ID NO: 3191 - protein, 16 aa, Artificial Sequence
  Synthetically generated peptide
  misc_feature (7)..(7): Xaa can be Cys or D-Cys
AVCCEVXCTPACTGCK

SEQ ID NO: 3192 - protein, 16 aa, Artificial Sequence
  Synthetically generated peptide
  misc_feature (7)..(7): Xaa can be Cys or D-Cys
AVCCEVXCTPACTGCY

SEQ ID NO: 3193 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AVCCEVXCTPACTGX

SEQ ID NO: 3194 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AVCCEVXCTPACTGXK

SEQ ID NO: 3195 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AVCCEVXCTPACTGXY

SEQ ID NO: 3196 - protein, 15 aa, Artificial Sequence
  Synthetically generated peptide
AVCCEICCNPACTGC

SEQ ID NO: 3197 - protein, 16 aa, Artificial Sequence
  Synthetically generated peptide
AVCCEICCNPACTGCK

SEQ ID NO: 3198 - protein, 16 aa, Artificial Sequence
  Synthetically generated peptide
AVCCEICCNPACTGCY

SEQ ID NO: 3199 - protein, 15 aa, Artificial Sequence
  Synthetically generated peptide
  misc_feature (15)..(15): Xaa can be Cys or D-Cys
AVCCEICCNPACTGX

SEQ ID NO: 3200 - protein, 16 aa, Artificial Sequence
  Synthetically generated peptide
  misc_feature (15)..(15): Xaa can be Cys or D-Cys
AVCCEICCNPACTGXK

SEQ ID NO: 3201 - protein, 16 aa, Artificial Sequence
  Synthetically generated peptide
  misc_feature (15)..(15): Xaa can be Cys or D-Cys
AVCCEICCNPACTGXY

SEQ ID NO: 3202 - protein, 15 aa, Artificial Sequence
  Synthetically generated peptide
AVCCEICCTPACTGC

SEQ ID NO: 3203 - protein, 16 aa, Artificial Sequence
  Synthetically generated peptide
AVCCEICCTPACTGCK

SEQ ID NO: 3204 - protein, 16 aa, Artificial Sequence
  Synthetically generated peptide
AVCCEICCTPACTGCY

SEQ ID NO: 3205 - protein, 15 aa, Artificial Sequence
  Synthetically generated peptide
  misc_feature (15)..(15): Xaa can be Cys or D-Cys
AVCCEICCTPACTGX

SEQ ID NO: 3206 - protein, 16 aa, Artificial Sequence
  Synthetically generated peptide
  misc_feature (15)..(15): Xaa can be Cys or D-Cys
AVCCEICCTPACTGXK

SEQ ID NO: 3207 - protein, 16 aa, Artificial Sequence
  Synthetically generated peptide
  misc_feature (15)..(15): Xaa can be Cys or D-Cys
AVCCEICCTPACTGXY

SEQ ID NO: 3208 - protein, 15 aa, Artificial Sequence
  Synthetically generated peptide
  misc_feature (7)..(7): Xaa can be Cys or D-Cys
AVCCEIXCNPACTGC

SEQ ID NO: 3209 - protein, 16 aa, Artificial Sequence
  Synthetically generated peptide
  misc_feature (7)..(7): Xaa can be Cys or D-Cys
AVCCEIXCNPACTGCK

SEQ ID NO: 3210 - protein, 16 aa, Artificial Sequence
  Synthetically generated peptide
  misc_feature (7)..(7): Xaa can be Cys or D-Cys
AVCCEIXCNPACTGCY

SEQ ID NO: 3211 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AVCCEIXCNPACTGX

SEQ ID NO: 3212 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AVCCEIXCNPACTGXK

SEQ ID NO: 3213 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AVCCEIXCNPACTGXY

SEQ ID NO: 3214 - protein, 15 aa, Artificial Sequence
  Synthetically generated peptide
  misc_feature (7)..(7): Xaa can be Cys or D-Cys
AVCCEIXCTPACTGC

SEQ ID NO: 3215 - protein, 16 aa, Artificial Sequence
  Synthetically generated peptide
  misc_feature (7)..(7): Xaa can be Cys or D-Cys
AVCCEIXCTPACTGCK

SEQ ID NO: 3216 - protein, 16 aa, Artificial Sequence
  Synthetically generated peptide
  misc_feature (7)..(7): Xaa can be Cys or D-Cys
AVCCEIXCTPACTGCY

SEQ ID NO: 3217 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AVCCEIXCTPACTGX

SEQ ID NO: 3218 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AVCCEIXCTPACTGXK

SEQ ID NO: 3219 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AVCCEIXCTPACTGXY

SEQ ID NO: 3220 - protein, 15 aa, Artificial Sequence
  Synthetically generated peptide
AVCCELCCNPACTGC

SEQ ID NO: 3221 - protein, 16 aa, Artificial Sequence
  Synthetically generated peptide
AVCCELCCNPACTGCK

SEQ ID NO: 3222 - protein, 16 aa, Artificial Sequence
  Synthetically generated peptide
AVCCELCCNPACTGCY

SEQ ID NO: 3223 - protein, 15 aa, Artificial Sequence
  Synthetically generated peptide
  misc_feature (15)..(15): Xaa can be Cys or D-Cys
AVCCELCCNPACTGX

SEQ ID NO: 3224 - protein, 16 aa, Artificial Sequence
  Synthetically generated peptide
  misc_feature (15)..(15): Xaa can be Cys or D-Cys
AVCCELCCNPACTGXK

SEQ ID NO: 3225 - protein, 16 aa, Artificial Sequence
  Synthetically generated peptide
  misc_feature (15)..(15): Xaa can be Cys or D-Cys
AVCCELCCNPACTGXY

SEQ ID NO: 3226 - protein, 15 aa, Artificial Sequence
  Synthetically generated peptide
AVCCELCCTPACTGC

SEQ ID NO: 3227 - protein, 16 aa, Artificial Sequence
  Synthetically generated peptide
AVCCELCCTPACTGCK

SEQ ID NO: 3228 - protein, 16 aa, Artificial Sequence
  Synthetically generated peptide
AVCCELCCTPACTGCY

SEQ ID NO: 3229 - protein, 15 aa, Artificial Sequence
  Synthetically generated peptide
  misc_feature (15)..(15): Xaa can be Cys or D-Cys
AVCCELCCTPACTGX

SEQ ID NO: 3230 - protein, 16 aa, Artificial Sequence
  Synthetically generated peptide
  misc_feature (15)..(15): Xaa can be Cys or D-Cys
AVCCELCCTPACTGXK

SEQ ID NO: 3231 - protein, 16 aa, Artificial Sequence
  Synthetically generated peptide
  misc_feature (15)..(15): Xaa can be Cys or D-Cys
AVCCELCCTPACTGXY

SEQ ID NO: 3232 - protein, 15 aa, Artificial Sequence
  Synthetically generated peptide
  misc_feature (7)..(7): Xaa can be Cys or D-Cys
AVCCELXCNPACTGC

SEQ ID NO: 3233 - protein, 16 aa, Artificial Sequence
  Synthetically generated peptide
  misc_feature (7)..(7): Xaa can be Cys or D-Cys
AVCCELXCNPACTGCK

SEQ ID NO: 3234 - protein, 16 aa, Artificial Sequence
  Synthetically generated peptide
  misc_feature (7)..(7): Xaa can be Cys or D-Cys
AVCCELXCNPACTGCY

SEQ ID NO: 3235 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AVCCELXCNPACTGX

SEQ ID NO: 3236 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AVCCELXCNPACTGXK

SEQ ID NO: 3237 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AVCCELXCNPACTGXY

SEQ ID NO: 3238 - protein, 15 aa, Artificial Sequence
  Synthetically generated peptide
  misc_feature (7)..(7): Xaa can be Cys or D-Cys
AVCCELXCTPACTGC

SEQ ID NO: 3239 - protein, 16 aa, Artificial Sequence
  Synthetically generated peptide
  misc_feature (7)..(7): Xaa can be Cys or D-Cys
AVCCELXCTPACTGCK

SEQ ID NO: 3240 - protein, 16 aa, Artificial Sequence
  Synthetically generated peptide
  misc_feature (7)..(7): Xaa can be Cys or D-Cys
AVCCELXCTPACTGCY

SEQ ID NO: 3241 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AVCCELXCTPACTGX

SEQ ID NO: 3242 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AVCCELXCTPACTGXK

SEQ ID NO: 3243 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AVCCELXCTPACTGXY

SEQ ID NO: 3244 - protein, 15 aa, Artificial Sequence
  Synthetically generated peptide
AVCCEYCCNPACTGC

SEQ ID NO: 3245 - protein, 16 aa, Artificial Sequence
  Synthetically generated peptide
AVCCEYCCNPACTGCK

SEQ ID NO: 3246 - protein, 16 aa, Artificial Sequence
  Synthetically generated peptide
AVCCEYCCNPACTGCY

SEQ ID NO: 3247 - protein, 15 aa, Artificial Sequence
  Synthetically generated peptide
  misc_feature (15)..(15): Xaa can be Cys or D-Cys
AVCCEYCCNPACTGX

SEQ ID NO: 3248 - protein, 16 aa, Artificial Sequence
  Synthetically generated peptide
  misc_feature (15)..(15): Xaa can be Cys or D-Cys
AVCCEYCCNPACTGXK

SEQ ID NO: 3249 - protein, 16 aa, Artificial Sequence
  Synthetically generated peptide
  misc_feature (15)..(15): Xaa can be Cys or D-Cys
AVCCEYCCNPACTGXY

SEQ ID NO: 3250 - protein, 15 aa, Artificial Sequence
  Synthetically generated peptide
AVCCEYCCTPACTGC

SEQ ID NO: 3251 - protein, 16 aa, Artificial Sequence
  Synthetically generated peptide
AVCCEYCCTPACTGCK

SEQ ID NO: 3252 - protein, 16 aa, Artificial Sequence
  Synthetically generated peptide
AVCCEYCCTPACTGCY

SEQ ID NO: 3253 - protein, 15 aa, Artificial Sequence
  Synthetically generated peptide
  misc_feature (15)..(15): Xaa can be Cys or D-Cys
AVCCEYCCTPACTGX

SEQ ID NO: 3254 - protein, 16 aa, Artificial Sequence
  Synthetically generated peptide
  misc_feature (15)..(15): Xaa can be Cys or D-Cys
AVCCEYCCTPACTGXK

SEQ ID NO: 3255 - protein, 16 aa, Artificial Sequence
  Synthetically generated peptide
  misc_feature (15)..(15): Xaa can be Cys or D-Cys
AVCCEYCCTPACTGXY

SEQ ID NO: 3256 - protein, 15 aa, Artificial Sequence
  Synthetically generated peptide
  misc_feature (7)..(7): Xaa can be Cys or D-Cys
AVCCEYXCNPACTGC

SEQ ID NO: 3257 - protein, 16 aa, Artificial Sequence
  Synthetically generated peptide
  misc_feature (7)..(7): Xaa can be Cys or D-Cys
AVCCEYXCNPACTGCK

SEQ ID NO: 3258 - protein, 16 aa, Artificial Sequence
  Synthetically generated peptide
  misc_feature (7)..(7): Xaa can be Cys or D-Cys
AVCCEYXCNPACTGCY

SEQ ID NO: 3259 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AVCCEYXCNPACTGX

SEQ ID NO: 3260 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AVCCEYXCNPACTGXK

SEQ ID NO: 3261 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AVCCEYXCNPACTGXY

SEQ ID NO: 3262 - protein, 15 aa, Artificial Sequence
  Synthetically generated peptide
  misc_feature (7)..(7): Xaa can be Cys or D-Cys
AVCCEYXCTPACTGC

SEQ ID NO: 3263 - protein, 16 aa, Artificial Sequence
  Synthetically generated peptide
  misc_feature (7)..(7): Xaa can be Cys or D-Cys
AVCCEYXCTPACTGCK

SEQ ID NO: 3264 - protein, 16 aa, Artificial Sequence
  Synthetically generated peptide
  misc_feature (7)..(7): Xaa can be Cys or D-Cys
AVCCEYXCTPACTGCY

SEQ ID NO: 3265 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AVCCEYXCTPACTGX

SEQ ID NO: 3266 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AVCCEYXCTPACTGXK

SEQ ID NO: 3267 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AVCCEYXCTPACTGXY

SEQ ID NO: 3268 - protein, 15 aa, Artificial Sequence
  Synthetically generated peptide
AVCCEFCCNPACTGC

SEQ ID NO: 3269 - protein, 16 aa, Artificial Sequence
  Synthetically generated peptide
AVCCEFCCNPACTGCK

SEQ ID NO: 3270 - protein, 16 aa, Artificial Sequence
  Synthetically generated peptide
AVCCEFCCNPACTGCY

SEQ ID NO: 3271 - protein, 15 aa, Artificial Sequence
  Synthetically generated peptide
  misc_feature (15)..(15): Xaa can be Cys or D-Cys
AVCCEFCCNPACTGX

SEQ ID NO: 3272 - protein, 16 aa, Artificial Sequence
  Synthetically generated peptide
  misc_feature (15)..(15): Xaa can be Cys or D-Cys
AVCCEFCCNPACTGXK

SEQ ID NO: 3273 - protein, 16 aa, Artificial Sequence
  Synthetically generated peptide
  misc_feature (15)..(15): Xaa can be Cys or D-Cys
AVCCEFCCNPACTGXY

SEQ ID NO: 3274 - protein, 15 aa, Artificial Sequence
  Synthetically generated peptide
AVCCEFCCTPACTGC

SEQ ID NO: 3275 - protein, 16 aa, Artificial Sequence
  Synthetically generated peptide
AVCCEFCCTPACTGCK

SEQ ID NO: 3276 - protein, 16 aa, Artificial Sequence
  Synthetically generated peptide
AVCCEFCCTPACTGCY

SEQ ID NO: 3277 - protein, 15 aa, Artificial Sequence
  Synthetically generated peptide
  misc_feature (15)..(15): Xaa can be Cys or D-Cys
AVCCEFCCTPACTGX

SEQ ID NO: 3278 - protein, 16 aa, Artificial Sequence
  Synthetically generated peptide
  misc_feature (15)..(15): Xaa can be Cys or D-Cys
AVCCEFCCTPACTGXK

SEQ ID NO: 3279 - protein, 16 aa, Artificial Sequence
  Synthetically generated peptide
  misc_feature (15)..(15): Xaa can be Cys or D-Cys
AVCCEFCCTPACTGXY

SEQ ID NO: 3280 - protein, 15 aa, Artificial Sequence
  Synthetically generated peptide
  misc_feature (7)..(7): Xaa can be Cys or D-Cys
AVCCEFXCNPACTGC

SEQ ID NO: 3281 - protein, 16 aa, Artificial Sequence
  Synthetically generated peptide
  misc_feature (7)..(7): Xaa can be Cys or D-Cys
AVCCEFXCNPACTGCK

SEQ ID NO: 3282 - protein, 16 aa, Artificial Sequence
  Synthetically generated peptide
  misc_feature (7)..(7): Xaa can be Cys or D-Cys
AVCCEFXCNPACTGCY

SEQ ID NO: 3283 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AVCCEFXCNPACTGX

SEQ ID NO: 3284 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AVCCEFXCNPACTGXK

SEQ ID NO: 3285 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AVCCEFXCNPACTGXY

SEQ ID NO: 3286 - protein, 15 aa, Artificial Sequence
  Synthetically generated peptide
  misc_feature (7)..(7): Xaa can be Cys or D-Cys
AVCCEFXCTPACTGC

SEQ ID NO: 3287 - protein, 16 aa, Artificial Sequence
  Synthetically generated peptide
  misc_feature (7)..(7): Xaa can be Cys or D-Cys
AVCCEFXCTPACTGCK

SEQ ID NO: 3288 - protein, 16 aa, Artificial Sequence
  Synthetically generated peptide
  misc_feature (7)..(7): Xaa can be Cys or D-Cys
AVCCEFXCTPACTGCY

SEQ ID NO: 3289 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AVCCEFXCTPACTGX

SEQ ID NO: 3290 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AVCCEFXCTPACTGXK

SEQ ID NO: 3291 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AVCCEFXCTPACTGXY

SEQ ID NO: 3292 - protein, 15 aa, Artificial Sequence
  Synthetically generated peptide
AVCCEWCCNPACTGC

SEQ ID NO: 3293 - protein, 16 aa, Artificial Sequence
  Synthetically generated peptide
AVCCEWCCNPACTGCK

SEQ ID NO: 3294 - protein, 16 aa, Artificial Sequence
  Synthetically generated peptide
AVCCEWCCNPACTGCY

SEQ ID NO: 3295 - protein, 15 aa, Artificial Sequence
  Synthetically generated peptide
  misc_feature (15)..(15): Xaa can be Cys or D-Cys
AVCCEWCCNPACTGX

SEQ ID NO: 3296 - protein, 16 aa, Artificial Sequence
  Synthetically generated peptide
  misc_feature (15)..(15): Xaa can be Cys or D-Cys
AVCCEWCCNPACTGXK

SEQ ID NO: 3297 - protein, 16 aa, Artificial Sequence
  Synthetically generated peptide
  misc_feature (15)..(15): Xaa can be Cys or D-Cys
AVCCEWCCNPACTGXY

SEQ ID NO: 3298 - protein, 15 aa, Artificial Sequence
  Synthetically generated peptide
AVCCEWCCTPACTGC

SEQ ID NO: 3299 - protein, 16 aa, Artificial Sequence
  Synthetically generated peptide
AVCCEWCCTPACTGCK

SEQ ID NO: 3300 - protein, 16 aa, Artificial Sequence
  Synthetically generated peptide
AVCCEWCCTPACTGCY

SEQ ID NO: 3301 - protein, 15 aa, Artificial Sequence
  Synthetically generated peptide
  misc_feature (15)..(15): Xaa can be Cys or D-Cys
AVCCEWCCTPACTGX

SEQ ID NO: 3302 - protein, 16 aa, Artificial Sequence
  Synthetically generated peptide
  misc_feature (15)..(15): Xaa can be Cys or D-Cys
AVCCEWCCTPACTGXK

SEQ ID NO: 3303 - protein, 16 aa, Artificial Sequence
  Synthetically generated peptide
  misc_feature (15)..(15): Xaa can be Cys or D-Cys
AVCCEWCCTPACTGXY

SEQ ID NO: 3304 - protein, 15 aa, Artificial Sequence
  Synthetically generated peptide
  misc_feature (7)..(7): Xaa can be Cys or D-Cys
AVCCEWXCNPACTGC

SEQ ID NO: 3305 - protein, 16 aa, Artificial Sequence
  Synthetically generated peptide
  misc_feature (7)..(7): Xaa can be Cys or D-Cys
AVCCEWXCNPACTGCK

SEQ ID NO: 3306 - protein, 16 aa, Artificial Sequence
  Synthetically generated peptide
  misc_feature (7)..(7): Xaa can be Cys or D-Cys
AVCCEWXCNPACTGCY

SEQ ID NO: 3307 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AVCCEWXCNPACTGX

SEQ ID NO: 3308 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AVCCEWXCNPACTGXK

SEQ ID NO: 3309 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AVCCEWXCNPACTGXY

SEQ ID NO: 3310 - protein, 15 aa, Artificial Sequence
  Synthetically generated peptide
  misc_feature (7)..(7): Xaa can be Cys or D-Cys
AVCCEWXCTPACTGC

SEQ ID NO: 3311 - protein, 16 aa, Artificial Sequence
  Synthetically generated peptide
  misc_feature (7)..(7): Xaa can be Cys or D-Cys
AVCCEWXCTPACTGCK

SEQ ID NO: 3312 - protein, 16 aa, Artificial Sequence
  Synthetically generated peptide
  misc_feature (7)..(7): Xaa can be Cys or D-Cys
AVCCEWXCTPACTGCY

SEQ ID NO: 3313 - protein, 15 aa, Artificial Sequence
  Synthetically generated peptide
  misc_feature (7)..(7): Xaa can be Cys or D-Cys
  misc_feature (15)..(15): Xaa can be Cys or D-Cys
AVCCEWXCTPACTGX

SEQ ID NO: 3314 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AVCCEWXCTPACTGXK

SEQ ID NO: 3315 - protein, 16 aa, Artificial Sequence
  Synthetically generated peptide
  misc_feature (7)..(7): Xaa can be Cys or D-Cys
  misc_feature (15)..(15): Xaa can be Cys or D-Cys
AVCCEWXCTPACTGXY

SEQ ID NO: 3316 - protein, 15 aa, Artificial Sequence
  Synthetically generated peptide
  misc_feature (3)..(3): Xaa can be Cys or D-Cys
AVXCEVCCNPACTGC

SEQ ID NO: 3317 - protein, 16 aa, Artificial Sequence
  Synthetically generated peptide
  misc_feature (3)..(3): Xaa can be Cys or D-Cys
AVXCEVCCNPACTGCK

SEQ ID NO: 3318 - protein, 16 aa, Artificial Sequence
  Synthetically generated peptide
  misc_feature (3)..(3): Xaa can be Cys or D-Cys
AVXCEVCCNPACTGCY

SEQ ID NO: 3319 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AVXCEVCCNPACTGX

SEQ ID NO: 3320 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AVXCEVCCNPACTGXK

SEQ ID NO: 3321 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AVXCEVCCNPACTGXY

SEQ ID NO: 3322 - protein, 15 aa, Artificial Sequence
  Synthetically generated peptide
  misc_feature (3)..(3): Xaa can be Cys or D-Cys
AVXCEVCCTPACTGC

SEQ ID NO: 3323 - protein, 16 aa, Artificial Sequence
  Synthetically generated peptide
  misc_feature (3)..(3): Xaa can be Cys or D-Cys
AVXCEVCCTPACTGCK

SEQ ID NO: 3324 - protein, 16 aa, Artificial Sequence
  Synthetically generated peptide
  misc_feature (3)..(3): Xaa can be Cys or D-Cys
AVXCEVCCTPACTGCY

SEQ ID NO: 3325 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AVXCEVCCTPACTGX

SEQ ID NO: 3326 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AVXCEVCCTPACTGXK

SEQ ID NO: 3327 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AVXCEVCCTPACTGXY

SEQ ID NO: 3328 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AVXCEVXCNPACTGC

SEQ ID NO: 3329 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AVXCEVXCNPACTGCK

SEQ ID NO: 3330 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AVXCEVXCNPACTGCY

SEQ ID NO: 3331 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCEVXCNPACTGX

SEQ ID NO: 3332 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCEVXCNPACTGXK

SEQ ID NO: 3333 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCEVXCNPACTGXY

SEQ ID NO: 3334 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AVXCEVXCTPACTGC

SEQ ID NO: 3335 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AVXCEVXCTPACTGCK

SEQ ID NO: 3336 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AVXCEVXCTPACTGCY

SEQ ID NO: 3337 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCEVXCTPACTGX

SEQ ID NO: 3338 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCEVXCTPACTGXK

SEQ ID NO: 3339 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCEVXCTPACTGXY

SEQ ID NO: 3340 - protein, 15 aa, Artificial Sequence
  Synthetically generated peptide
  misc_feature (3)..(3): Xaa can be Cys or D-Cys
AVXCEICCNPACTGC

SEQ ID NO: 3341 - protein, 16 aa, Artificial Sequence
  Synthetically generated peptide
  misc_feature (3)..(3): Xaa can be Cys or D-Cys
AVXCEICCNPACTGCK

SEQ ID NO: 3342 - protein, 16 aa, Artificial Sequence
  Synthetically generated peptide
  misc_feature (3)..(3): Xaa can be Cys or D-Cys
AVXCEICCNPACTGCY

SEQ ID NO: 3343 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AVXCEICCNPACTGX

SEQ ID NO: 3344 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AVXCEICCNPACTGXK

SEQ ID NO: 3345 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AVXCEICCNPACTGXY

SEQ ID NO: 3346 - protein, 15 aa, Artificial Sequence
  Synthetically generated peptide
  misc_feature (3)..(3): Xaa can be Cys or D-Cys
AVXCEICCTPACTGC

SEQ ID NO: 3347 - protein, 16 aa, Artificial Sequence
  Synthetically generated peptide
  misc_feature (3)..(3): Xaa can be Cys or D-Cys
AVXCEICCTPACTGCK

SEQ ID NO: 3348 - protein, 16 aa, Artificial Sequence
  Synthetically generated peptide
  misc_feature (3)..(3): Xaa can be Cys or D-Cys
AVXCEICCTPACTGCY

SEQ ID NO: 3349 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AVXCEICCTPACTGX

SEQ ID NO: 3350 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AVXCEICCTPACTGXK

SEQ ID NO: 3351 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AVXCEICCTPACTGXY

SEQ ID NO: 3352 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AVXCEIXCNPACTGC

SEQ ID NO: 3353 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AVXCEIXCNPACTGCK

SEQ ID NO: 3354 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AVXCEIXCNPACTGCY

SEQ ID NO: 3355 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCEIXCNPACTGX

SEQ ID NO: 3356 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCEIXCNPACTGXK

SEQ ID NO: 3357 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCEIXCNPACTGXY

SEQ ID NO: 3358 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AVXCEIXCTPACTGC

SEQ ID NO: 3359 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AVXCEIXCTPACTGCK

SEQ ID NO: 3360 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AVXCEIXCTPACTGCY

SEQ ID NO: 3361 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCEIXCTPACTGX

SEQ ID NO: 3362 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCEIXCTPACTGXK

SEQ ID NO: 3363 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCEIXCTPACTGXY

SEQ ID NO: 3364 - protein, 15 aa, Artificial Sequence
  Synthetically generated peptide
  misc_feature (3)..(3): Xaa can be Cys or D-Cys
AVXCELCCNPACTGC

SEQ ID NO: 3365 - protein, 16 aa, Artificial Sequence
  Synthetically generated peptide
  misc_feature (3)..(3): Xaa can be Cys or D-Cys
AVXCELCCNPACTGCK

SEQ ID NO: 3366 - protein, 16 aa, Artificial Sequence
  Synthetically generated peptide
  misc_feature (3)..(3): Xaa can be Cys or D-Cys
AVXCELCCNPACTGCY

SEQ ID NO: 3367 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AVXCELCCNPACTGX

SEQ ID NO: 3368 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AVXCELCCNPACTGXK

SEQ ID NO: 3369 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AVXCELCCNPACTGXY

SEQ ID NO: 3370 - protein, 15 aa, Artificial Sequence
  Synthetically generated peptide
  misc_feature (3)..(3): Xaa can be Cys or D-Cys
AVXCELCCTPACTGC

SEQ ID NO: 3371 - protein, 16 aa, Artificial Sequence
  Synthetically generated peptide
  misc_feature (3)..(3): Xaa can be Cys or D-Cys
AVXCELCCTPACTGCK

SEQ ID NO: 3372 - protein, 16 aa, Artificial Sequence
  Synthetically generated peptide
  misc_feature (3)..(3): Xaa can be Cys or D-Cys
AVXCELCCTPACTGCY

SEQ ID NO: 3373 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AVXCELCCTPACTGX

SEQ ID NO: 3374 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AVXCELCCTPACTGXK

SEQ ID NO: 3375 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AVXCELCCTPACTGXY

SEQ ID NO: 3376 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AVXCELXCNPACTGC

SEQ ID NO: 3377 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AVXCELXCNPACTGCK

SEQ ID NO: 3378 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AVXCELXCNPACTGCY

SEQ ID NO: 3379 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCELXCNPACTGX

SEQ ID NO: 3380 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCELXCNPACTGXK

SEQ ID NO: 3381 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCELXCNPACTGXY

SEQ ID NO: 3382 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AVXCELXCTPACTGC

SEQ ID NO: 3383 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AVXCELXCTPACTGCK

SEQ ID NO: 3384 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AVXCELXCTPACTGCY

SEQ ID NO: 3385 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCELXCTPACTGX

SEQ ID NO: 3386 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCELXCTPACTGXK

SEQ ID NO: 3387 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCELXCTPACTGXY

SEQ ID NO: 3388 - protein, 15 aa, Artificial Sequence
  Synthetically generated peptide
  misc_feature (3)..(3): Xaa can be Cys or D-Cys
AVXCEYCCNPACTGC

SEQ ID NO: 3389 - protein, 16 aa, Artificial Sequence
  Synthetically generated peptide
  misc_feature (3)..(3): Xaa can be Cys or D-Cys
AVXCEYCCNPACTGCK

SEQ ID NO: 3390 - protein, 16 aa, Artificial Sequence
  Synthetically generated peptide
  misc_feature (3)..(3): Xaa can be Cys or D-Cys
AVXCEYCCNPACTGCY

SEQ ID NO: 3391 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AVXCEYCCNPACTGX

SEQ ID NO: 3392 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AVXCEYCCNPACTGXK

SEQ ID NO: 3393 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AVXCEYCCNPACTGXY

SEQ ID NO: 3394 - protein, 15 aa, Artificial Sequence
  Synthetically generated peptide
  misc_feature (3)..(3): Xaa can be Cys or D-Cys
AVXCEYCCTPACTGC

SEQ ID NO: 3395 - protein, 16 aa, Artificial Sequence
  Synthetically generated peptide
  misc_feature (3)..(3): Xaa can be Cys or D-Cys
AVXCEYCCTPACTGCK

SEQ ID NO: 3396 - protein, 16 aa, Artificial Sequence
  Synthetically generated peptide
  misc_feature (3)..(3): Xaa can be Cys or D-Cys
AVXCEYCCTPACTGCY

SEQ ID NO: 3397 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AVXCEYCCTPACTGX

SEQ ID NO: 3398 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AVXCEYCCTPACTGXK

SEQ ID NO: 3399 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AVXCEYCCTPACTGXY

SEQ ID NO: 3400 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AVXCEYXCNPACTGC

SEQ ID NO: 3401 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AVXCEYXCNPACTGCK

SEQ ID NO: 3402 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AVXCEYXCNPACTGCY

SEQ ID NO: 3403 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCEYXCNPACTGX

SEQ ID NO: 3404 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCEYXCNPACTGXK

SEQ ID NO: 3405 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCEYXCNPACTGXY

SEQ ID NO: 3406 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AVXCEYXCTPACTGC

SEQ ID NO: 3407 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AVXCEYXCTPACTGCK

SEQ ID NO: 3408 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AVXCEYXCTPACTGCY

SEQ ID NO: 3409 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCEYXCTPACTGX

SEQ ID NO: 3410 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCEYXCTPACTGXK

SEQ ID NO: 3411 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCEYXCTPACTGXY

SEQ ID NO: 3412 - protein, 15 aa, Artificial Sequence
  Synthetically generated peptide
  misc_feature (3)..(3): Xaa can be Cys or D-Cys
AVXCEFCCNPACTGC

SEQ ID NO: 3413 - protein, 16 aa, Artificial Sequence
  Synthetically generated peptide
  misc_feature (3)..(3): Xaa can be Cys or D-Cys
AVXCEFCCNPACTGCK

SEQ ID NO: 3414 - protein, 16 aa, Artificial Sequence
  Synthetically generated peptide
  misc_feature (3)..(3): Xaa can be Cys or D-Cys
AVXCEFCCNPACTGCY

SEQ ID NO: 3415 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AVXCEFCCNPACTGX

SEQ ID NO: 3416 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AVXCEFCCNPACTGXK

SEQ ID NO: 3417 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AVXCEFCCNPACTGXY

SEQ ID NO: 3418 - protein, 15 aa, Artificial Sequence
  Synthetically generated peptide
  misc_feature (3)..(3): Xaa can be Cys or D-Cys
AVXCEFCCTPACTGC

SEQ ID NO: 3419 - protein, 16 aa, Artificial Sequence
  Synthetically generated peptide
  misc_feature (3)..(3): Xaa can be Cys or D-Cys
AVXCEFCCTPACTGCK

SEQ ID NO: 3420 - protein, 16 aa, Artificial Sequence
  Synthetically generated peptide
  misc_feature (3)..(3): Xaa can be Cys or D-Cys
AVXCEFCCTPACTGCY

SEQ ID NO: 3421 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AVXCEFCCTPACTGX

SEQ ID NO: 3422 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AVXCEFCCTPACTGXK

SEQ ID NO: 3423 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AVXCEFCCTPACTGXY

SEQ ID NO: 3424 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AVXCEFXCNPACTGC

SEQ ID NO: 3425 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AVXCEFXCNPACTGCK

SEQ ID NO: 3426 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AVXCEFXCNPACTGCY

SEQ ID NO: 3427 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCEFXCNPACTGX

SEQ ID NO: 3428 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCEFXCNPACTGXK

SEQ ID NO: 3429 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCEFXCNPACTGXY

SEQ ID NO: 3430 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AVXCEFXCTPACTGC

SEQ ID NO: 3431 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AVXCEFXCTPACTGCK

SEQ ID NO: 3432 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AVXCEFXCTPACTGCY

SEQ ID NO: 3433 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCEFXCTPACTGX

SEQ ID NO: 3434 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCEFXCTPACTGXK

SEQ ID NO: 3435 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCEFXCTPACTGXY

SEQ ID NO: 3436 - protein, 15 aa, Artificial Sequence
  Synthetically generated peptide
  misc_feature (3)..(3): Xaa can be Cys or D-Cys
AVXCEWCCNPACTGC

SEQ ID NO: 3437 - protein, 16 aa, Artificial Sequence
  Synthetically generated peptide
  misc_feature (3)..(3): Xaa can be Cys or D-Cys
AVXCEWCCNPACTGCK

SEQ ID NO: 3438 - protein, 16 aa, Artificial Sequence
  Synthetically generated peptide
  misc_feature (3)..(3): Xaa can be Cys or D-Cys
AVXCEWCCNPACTGCY

SEQ ID NO: 3439 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AVXCEWCCNPACTGX

SEQ ID NO: 3440 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AVXCEWCCNPACTGXK

SEQ ID NO: 3441 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AVXCEWCCNPACTGXY

SEQ ID NO: 3442 - protein, 15 aa, Artificial Sequence
  Synthetically generated peptide
  misc_feature (3)..(3): Xaa can be Cys or D-Cys
AVXCEWCCTPACTGC

SEQ ID NO: 3443 - protein, 16 aa, Artificial Sequence
  Synthetically generated peptide
  misc_feature (3)..(3): Xaa can be Cys or D-Cys
AVXCEWCCTPACTGCK

SEQ ID NO: 3444 - protein, 16 aa, Artificial Sequence
  Synthetically generated peptide
  misc_feature (3)..(3): Xaa can be Cys or D-Cys
AVXCEWCCTPACTGCY

SEQ ID NO: 3445 - protein, 15 aa, Artificial Sequence
  Synthetically generated peptide
  misc_feature (3)..(3): Xaa can be Cys or D-Cys
  misc_feature (15)..(15): Xaa can be Cys or D-Cys
AVXCEWCCTPACTGX

SEQ ID NO: 3446 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AVXCEWCCTPACTGXK

SEQ ID NO: 3447 - protein, 16 aa, Artificial Sequence
  Synthetically generated peptide
  misc_feature (3)..(3): Xaa can be Cys or D-Cys
  misc_feature (15)..(15): Xaa can be Cys or D-Cys
AVXCEWCCTPACTGXY

SEQ ID NO: 3448 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AVXCEWXCNPACTGC

SEQ ID NO: 3449 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AVXCEWXCNPACTGCK

SEQ ID NO: 3450 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AVXCEWXCNPACTGCY

SEQ ID NO: 3451 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCEWXCNPACTGX

SEQ ID NO: 3452 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCEWXCNPACTGXK

SEQ ID NO: 3453 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCEWXCNPACTGXY

SEQ ID NO: 3454 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
AVXCEWXCTPACTGC

SEQ ID NO: 3455 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AVXCEWXCTPACTGCK

SEQ ID NO: 3456 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
AVXCEWXCTPACTGCY

SEQ ID NO: 3457 - protein, 15 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCEWXCTPACTGX

SEQ ID NO: 3458 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCEWXCTPACTGXK

SEQ ID NO: 3459 - protein, 16 aa, Artificial Sequence
  Synthetically generated peptide
  misc_feature (3)..(3): Xaa can be Cys or D-Cys
  misc_feature (7)..(7): Xaa can be Cys or D-Cys
  misc_feature (15)..(15): Xaa can be Cys or D-Cys
AVXCEWXCTPACTGXY

SEQ ID NO: 3460 - protein, 19 aa, Escherichia coli
NSSNYCCELCCNPACTGCY

SEQ ID NO: 3461 - protein, 18 aa, Escherichia coli
NTFYCCELCCNPACAGCY

SEQ ID NO: 3462 - protein, 18 aa, Escherichia coli
NTFYCCELCCYPACAGCN

SEQ ID NO: 3463 - protein, 18 aa, Citrobacter freundii
NTFYCCELCCNPACAGCY

SEQ ID NO: 3464 - protein, 30 aa, Yersinia enterocolitica
QACDPPSPPAEVSSDWDCCDVCCNPACAGC

SEQ ID NO: 3465 - protein, 30 aa, Yersinia species
QACDPPLPPAEVSSDWDCCDVCCNPACAGC

SEQ ID NO: 3466 - protein, 30 aa, Yersinia species
KACDTQTPSPSEENDDWCCEVCCNPACAGC

SEQ ID NO: 3467 - protein, 53 aa, Yersinia species
QETASGQVGDVSSSTIATEVSEAECGTQSATTQGENDWDWCCELCCNPACFGC

SEQ ID NO: 3468 - protein, 16 aa, Yersinia kristensenii
SDWCCEVCCNPACAGC

SEQ ID NO: 3469 - protein, 17 aa, Vibrio cholerae
IDCCEICCNPACFGCLN

SEQ ID NO: 3470 - protein, 17 aa, Vibrio mimicus
IDCCEICCNPACFGCLN

SEQ ID NO: 3471 - protein, 72 aa, Escherichia coli
MKKLMLAIFISVLSFPSFSQSTESLDSSKEKITLETKKCDVVKNNSEKKSENMNNTFYCCELCCNPACAGCY

SEQ ID NO: 3472 - protein, 72 aa, Escherichia coli
MKKSILFIFLSVLSFSPFAQDAKPVESSKEKITLESKKCNIAKKSNKSGPESMNSSNYCCELCCNPACTGCY

SEQ ID NO: 3473 - protein, 71 aa, Yersinia enterocolitica
MKKIVFVLVLMLSSFGAFGQETVSGQFSDALSTPITAEVYKQACDPPLPPAEVSSDWDCCDVCCNPACAGC

SEQ ID NO: 3474 - protein, 5 aa, Artificial Sequence
  Synthetically generated peptide
QHNPR

SEQ ID NO: 3475 - protein, 6 aa, Artificial Sequence
  Synthetically generated peptide
VQHNPR

SEQ ID NO: 3476 - protein, 7 aa, Artificial Sequence
  Synthetically generated peptide
VRQHNPR

SEQ ID NO: 3477 - protein, 8 aa, Artificial Sequence
  Synthetically generated peptide
VRGQHNPR

SEQ ID NO: 3478 - protein, 9 aa, Artificial Sequence
  Synthetically generated peptide
VRGPQHNPR

SEQ ID NO: 3479 - protein, 10 aa, Artificial Sequence
  Synthetically generated peptide
VRGPRQHNPR

SEQ ID NO: 3480 - protein, 11 aa, Artificial Sequence
  Synthetically generated peptide
VRGPRRQHNPR

SEQ ID NO: 3481 - protein, 6 aa, Artificial Sequence
  Synthetically generated peptide
RQHNPR

SEQ ID NO: 3482 - protein, 5 aa, Artificial Sequence
  Synthetically generated peptide
  MISC_FEATURE (2)..(2): Xaa is D-Lys.
  MISC_FEATURE (5)..(5): Xaa is L-homoserine.
YXGFX

SEQ ID NO: 3483 - protein, 34 aa, Artificial Sequence
  Synthetically generated peptide
  MISC_FEATURE (2)..(2): Xaa is D-Ala.
  MISC_FEATURE (4)..(4): Xaa is Phe-NH2.
IKPEAPGEDASPEELNRYYASLRHYLNLVTRQRY

SEQ ID NO: 3484 - protein, 34 aa, Artificial Sequence; identical to SEQ ID NO: 3483
  Synthetically generated peptide

SEQ ID NO: 3485 - protein, 13 aa, Artificial Sequence
  Synthetically generated peptide
  MISC_FEATURE (1)..(1): Xaa is D-Cys.
XCELCCNPACTGC

SEQ ID NO: 3486 - protein, 11 aa, Artificial Sequence
  Synthetically generated peptide
YGRKKRRQRRR

SEQ ID NO: 3487 - protein, 11 aa, Artificial Sequence
  Synthetically generated peptide
YARKARRQARR

SEQ ID NO: 3488 - protein, 11 aa, Artificial Sequence
  Synthetically generated peptide
YARAAARQARA

SEQ ID NO: 3489 - protein, 11 aa, Artificial Sequence
  Synthetically generated peptide
YARAARRAARR

SEQ ID NO: 3490 - protein, 11 aa, Artificial Sequence
  Synthetically generated peptide
YARAARRAARA

SEQ ID NO: 3491 - protein, 10 aa, Artificial Sequence
  Synthetically generated peptide
ARRRRRRRRR

SEQ ID NO: 3492 - protein, 11 aa, Artificial Sequence
  Synthetically generated peptide
YAAARRRRRRR

SEQ ID NO: 3493 - protein, 54 aa, Artificial Sequence
  Synthetically generated peptide
MKKSILFIFLSVLSFSPFAQDAKPVESSKEKITLESKKCNIAKKSNKSGPESMN

SEQ ID NO: 3494 - protein, 6 aa, Artificial Sequence
  Synthetically generated peptide
KYYRWR

SEQ ID NO: 3495 - protein, 6 aa, Artificial Sequence
  Synthetically generated peptide
RYYRWR

SEQ ID NO: 3496 - protein, 6 aa, Artificial Sequence
  Synthetically generated peptide
KWRYYR

SEQ ID NO: 3497 - protein, 6 aa, Artificial Sequence
  Synthetically generated peptide
RYYRWK

SEQ ID NO: 3498 - protein, 6 aa, Artificial Sequence
  Synthetically generated peptide
  MISC_FEATURE (1)..(1): Xaa1 is D-Arg.
  MISC_FEATURE (2)..(2): Xaa2 is D-Tyr.
  MISC_FEATURE (3)..(3): Xaa3 is D-Tyr.
  MISC_FEATURE (4)..(4): Xaa4 is D-Arg.
  MISC_FEATURE (5)..(5): Xaa5 is Trp.
  MISC_FEATURE (6)..(6): Xaa6 is D-Lys.
XXXXXX

SEQ ID NO: 3499 - protein, 6 aa, Artificial Sequence
  Synthetically generated peptide
RYYRWK

SEQ ID NO: 3500 - protein, 6 aa, Artificial Sequence
  Synthetically generated peptide
RYYRIR

SEQ ID NO: 3501 - protein, 6 aa, Artificial Sequence
  Synthetically generated peptide
RYYKIK

SEQ ID NO: 3502 - protein, 6 aa, Artificial Sequence
  Synthetically generated peptide.
RYYKIR

SEQ ID NO: 3503 - protein, 6 aa, Artificial Sequence
  Synthetically generated peptide
RYYKWR

SEQ ID NO: 3504 - protein, 6 aa, Artificial Sequence
  Synthetically generated peptide
RYYKWK

SEQ ID NO: 3505 - protein, 6 aa, Artificial Sequence
  Synthetically generated peptide
RYYRWR

SEQ ID NO: 3506 - protein, 6 aa, Artificial Sequence
  Synthetically generated peptide
RYYRWK

SEQ ID NO: 3507 - protein, 6 aa, Artificial Sequence
  Synthetically generated peptide
RYYRIK

SEQ ID NO: 3508 - protein, 6 aa, Artificial sequence
  Synthetically generated peptide
RYYKWR

SEQ ID NO: 3509 - protein, 6 aa, Artificial Sequence
  Synthetically generated peptide
RYYKWK

SEQ ID NO: 3510 - protein, 6 aa, Artificial Sequence
  Synthetically generated peptide
RYYRWK

SEQ ID NO: 3511 - protein, 6 aa, Artificial Sequence
  Synthetically generated peptide
KYYRWK

What is claimed is:

1. A method of treating a disorder comprising administering to a patient in need thereof an effective amount of a peptide consisting of the amino acid sequence D-Cys Cys Glu Leu Cys Cys Asn Pro Ala Cys Thr Gly Cys wherein said disorder is selected from heart failure, acute heart failure, or chronic heart failure.

* * * * *